United States Patent 12,491,220 (COMPOSITIONS CONTAINING INDOLE-DERIVED METABOLITES AND METHODS OF USE THEREOF) - sequence listing, part 13

SEQ ID NO: 14 - DNA, 3412782 bp, unidentified (residues 1,706,392-3,412,782 of 3,412,782)
  source 1..3412782: mol_type = genomic DNA; note = Lactiplantibacillus plantarum
gttagttggtgaatctggttcaggaaagaccacgaccgggcgttccatcattcacttatatgaaccaactgatggtgaaatcatttttgacggtaaggacgtttccaaattacacactaagaaggaacgccatgaatttcgccgggagatccaaatgatcttccaggacccatacgcctcattgaatccacgaatgaaagtcaaggatatcgtggcggaagggattgatattcacggtttagccaaggatgatgcagaccgaaccaagcaagttgaagacttgttggagacggttggtcttaacaaggaccactctagtcgttatccacatgaattttctggtggtcaacgtcaacggatcgggattgcccgggcgttagcggtagagcctaaattcatcattgctgatgaaccaatttctgcgctggacgtttcgattcaagcccaagtggttaatttgatgaaggaattacaagttaagcagaacttgacttatttatttattgcgcatgatttgtcaatggttaagtatatcagtgaccggatcggcgttatgcattacggtaagattctggaaattgggcctgcggatgaagtgtataaccatccgttgcacaagtacaccgagagtttgatctcggcggtgccggtacctgatccagagtttgaacgtaaccgtaagcaggttccttatgacgaaacgaccgaacatgacggtaagaagcggcgaatggtcgaaattgcaccagggcactttgtccgggcaactgaagacgaaatcccgatatacaccaagcgggctgttgacgcggggttaattacggaattttctgagtaacggctaataaaacagacggcgagtgcgaatactcgacgtctgttttattattcagtagaatatttaattaactgtttagataagtttattaattaataaccattataattaactcatgttaacttgacatataaatttaatatgtaaaaaatattgatggaattaattgtcaaaaagccgattaaatcgggaatagacggctatttttggccggctaaactgtgaccggtagtcaaagttatttgtgtaaattttgtaattatgcaataataatattgctaataaagtttgttaacaaatataactattcgtcttaataattgattcgcaccattttttaaaaaaatattgcgagtgaaacgttgacttaattgaggtcgtcaaggatacggttatcgagcggcaatgacgaatcgtatcaaaaatattgatttaacaggaatcaattcgcactatttttttaaaaaaatcatgcaaagggacaatggcttgttttgaacggttaatgaaaaaagtacaaatttcaggaaggatgctgttagtatgcaacaaccaattaattatattatgaatatcatgcaccttgaacgggacttaaaacgacttacgtcgaactggtcgtccgccacagggcttagtttgaacgagttacggatcttagtttatgtcgaacaacatcctggtatccagattggtgatgtggcaaatgcgttgaatgtggcgaaagcctcgttggcacaaaatattggcaccttgataacccaaggatggttgaaaagtcaaccaattaaacaagaccggcgtttacgggtcttaacgcttacgaaggctggtcaggatcgaatgaaggatgttgatgcacaattgactaaatcacttgacacgacaccagcaacacagttagcggatcaattatcagccttgcaattataggcagatgtacacgttcacggatattaagtgaagtaatatccttaacgcgggataaagggggagactctttgtcccgcgcttttgttttagtacttaatagtggggagcattataggttaacaattactttgtttagtttactctaggttaagtaatttaaacttaataagattgattgaggtgtaatggagcgtatgcattataatgttgaaccgctacgaacggaccaagaaatcgatgattttttatgggctgtttcacaagcgcgttatggggagcgtaatcgcatgattgttttggttggaattaacacgggattacgaatgagtgatattttacgactgaaggttgggcaagtacgtggcaaagatcgtgttatgatcatggaacaaaaaacgggcaagaagcgctggttgtttttgaaaaacctcaaaacggaattagcccactttacgcggtatcggggggcaaatgaaccgttattctgtagtggtcggggcggagctttaaccgttaatggtgtctatcgagtctttcagacggccggtgagtacctggagcgggatgatattggtacgcacacgttgcgcaagacgtttggctatcattattatcaaaagactcgtgacattgccggattgatgatgattttcaatcattccagcgagcaggtgacaaaacgctatattggcattgagcgtgataatttggaacgacaattatgggactttaaattaggtgtttaattatggcagagacgcggtctatttcatagcgactcaatgaagatttgaggtaggcacaaaaaagagccggaagtgtaaacgattgtttacgcttctggctctaaatttaattatcttattcggacttcgtctcagccgccaaaacaatcttgccgtcttcaacttttgcaaccatgttcttaacgtcgccgtgatccaaatagaaatcggcgatgcgatcttcgatttgttcctggataacacgccggagtgggcgagcccccatctgagggttgtaacctagttcaacgagtttttcctcgacaggttctgtgacgtgaacgtgtaagccttggttagctaacatgccgttgacatcttcgatcatcaaaccaacaattttcatcaagttttccttagataaagcgttgaattgaatgatgtcatcgaaccggtttaagaattctggcttgaagtagtccgtcaaccggctagtgatatcgtgcgtcttgccttcagcagcggcaccaaaaccgacattagcttcactgtcgccagtcccagcgttggaagtcatgatgatgatcgtatccttgaagctgacagtccgaccttgtgagtcggtcagccggccatcatcgaggatttgcaaaaacatgtgcatgacatccggatgagccttttcaacttcgtctagtaagactaggctatatggatgacgacgaacctgttcagttaactgaccggcttcttcgtagccgacatagccaggcggtgaaccgatcaacttagccactgaatgtggttccatgtattcactcatgtcaaaccgaatcatggcatcttgagaaccaaacagttccttagcaagttgtttagccaattcagttttaccaaccccggttgggccgacaaacatgaaggaaccaattggccggccagttccgttcagaccgattcgattacgccggatggcccgggcaactgcttcaaccgcttggtcttgaccaataaccgtactcttaaggtcgggtgctaaggtcttcatttgagcctgttccttagcctgcaagtcaccaactggaatacttgtcttttcttcgacaatttgttccatgtccttgaccgttacagtggcagtatcgttattaggctggtctgaactttcatcgggcttagctttttctaacttagcaacttgatcgcgatagtaggcggctttttcgtagtcttccttcttcaaggcgtcctgtttctgcttttctgcctcgtcgatcttttcttgaatcgtctttggatcgaccgtcttcaacgtcaagttcttacgtgaaccagcttcatcgagtaaatcgatggccttatcaggtaagaaacgatcttgaatgtaacgatttgacaacttgacggctgccacaatggcatcttgatcgtatttaacgtgatgatagtcttcgtacttcttctgaatgccttcgagaatcttgatagattcttccacgctcggttcgttgaccgtgaccggttggaaccggcgggcgagggcggcatccttttcgatgtcgcggtattcgtttaatgtcgtggccccaactaattggaaatcaccacgggcaagggcgggtttcagaacgttcccagcatccataccaccttcagcattaccggcacccatgatttcatggatttcgtcaatgaagaggatgatattcggattgctttgaacttccttcattaattgttgcattcgttgttcaaattgacctcgaataccggtgccttgaacaagggaagccacgtccaaacgaataatttctttatctaacaatttttgtggaacttgaccagaaacgattttctgtgctagtccttccacgaccgccgttttaccaaccccagcttcaccaattaaaacggggttattcttggtccggcgattcaaaatctcgataacccgattaatttcggtatcgcgaccaatcactggatcgattttgccctgtttagcttgcgctgttaagttgaagccgtattggccaaggaggccaccgccgttgttattgccacgacgattgccgccattaggaccagctggctgggtcggtggggtctgttgttgccggtaagcgttattaggatcaacaacgccaccctgcattgcacggaaaatgtcgtcaagaccaccaaaaccgaatggatcttgtgccatatcagcacctccaactccgttatttggttgctgttcctgattctttagcagttgatagcaattttgacaaaggttgatttgtcgccgctgaccgttgacgctcgtatataaatggatcgtcgcttcgttcttatggcaattgtcacaaagcattatgctgtcacacacctttcgcatcagaaatataactaaatcgattaggatcatagttaaaggttcatcggttctttgacctttgttgacctttgactattagtatagcgaatttacggactgttgcaagtgaaaagcctcagggtcaaaactggacgtgcggccgggataattcgcaatggctgattgattcaattatttctgaatagtctggatagtcgcaactcatagcttgtcatgtaaccggattcgttgtatattaattatctggttaggataagtgatgatgtaactgtctgtctatattatagtacaaagcggtttttttgcatgtatcgagcctgaccagttttgatgtttgcagcgcatcgtttttcattggtgaccgtcaacagccagtgagcggcggagaactttgttcgtaaatatcaaaataatgatgcagtaatgtgtcaacctaactttgaggaggcggtaattgtttggcaacggattatacccagttaatggaagcgttgcgtcatggcgaacgcgacagttttaccgtaacgccggatgaatttatggcttttcacgacgcctatatgaagtatgagtatcgtaaacgagtcattggtacggcggacttagatggccgcattgtttaccatttcgagaaggatggtaagacaaccaattaataggcctagcttgaatgaaagggcttgtattttaattggataattgctatcatcattattaagggctcttgagtatacgtgttggcggcaactcgaattgactcggaaccaattttaaattttatctatcttgaaggagatcgaatagttatggaaaagaaagaatttcacgtaatcgcagacactggtatccacgcacgtcccgcaactttattggtacaatcagcaagtaagttcaactcagaaattacgttgcaataccaagacaagtccgttaacttaaagtccatcatgggtgttatgtcactcggtgttggtaaagatgctgacgttaccatttctgctgaaggtgccgacgaagccgacgctatcgcagctttaactgaaacgatgaagaaagaaggattatctgaataatggctgaaaaggtactaaaaggaattgcggccagtgatggcgttgcaattgctaaggcctatatgctagttgatccagatttatcattcgaaaagacaacagtttccgatacggatgctgaagttgcacggttacatgacgctttcgatgcttccaaggctgaactaaaggtcattaaagacaaagcggttgaaaacttgggtgaagaagaagcagaagtttttgaagctcatatcaccattttgtctgacccagaaatgctcggacaaattgaaggtaagatcaaggatgataaagtcaatgctgaagaagccttgaaggaagttactgatactttcatttcaatgttcgaagcgatgacggataatgcatatatgcaagaacgagccggtgatattcgcgacgtgacgaagcgggtcttaagccacttgttaggggtaaccttaccaagtccagcgttaattgactccgaagtaattgtggttgcccacgatttaacacctagtgatacagctcaacttgatcgtaagtatgttaagggcttcattactgacattggtggtcggactagtcattcagccatcatgtcacggacgcttgaaattccagcggtcgttggttctgaatccgctacgactgatatcaaagaaggcgacacggtcgtcttggatggtatcaatggtgacgctttagttgccccaacggatgctgaagttgctgattaccaacaaaaggctaaggactttgttgcgcaaaaggctgaatgggctaagttgaagaacgaagccaccgtgtctaaagacggcaagcactttgaattagcttctaacatcgggacgcctgacgatatggacggcgttttggatgctggctctgaagccattgggttattccgttcagaattcttgtacatgaacagttcagaattacctgacgaagatacccaattcgaagcttataagaaggttgtcgaaggcatgaacggcaaacccgttatcgttcggaccatggatatcggtggtgacaaggaattaccttacttgccattacctgatgaaatgaacccattcttgggctaccgggcaattcggatttctctcgatcgtgatgacatcttccggacccagttacgtgcgttattacgtgcgtcacattatggtcaattacggattatgttcccaatgattgcaacgcttgacgaattccgtaaagccaaggcaatttttgaggaagaaaaagcgaagttagtcgcagctggtacgccagttgctgatgacattaagcttggtatcatgattgaaatcccagcggcagctattttagctgaccaatttgctaaggaagttgacttctttagtattgggactaacgacttgatccaatactcatttgctgccgatcgtggtaacgaacaagtgtcatacttgtatcaaccatacaacccatcgttgttacgtttgatcaagcatgtcattgacgctgctcacgctaacggtcgcttcacgggtatgtgtggtgaagttgctggggatcagattgcggtgccattattgatgggcttaggtttggatgaattctcaatgagttcaacttccgtgcttaagacacgttcattaatgaagaaactcgatactaaggaaatggctaaattagcagataaggcactcaacgagtgtgttactaacgaagaagtcaaagaattagttgaaaagaacgtcttcggtaaataaacaatcaaattaagagcaaatctgcggatttgctctttttttattgccaaatgttgggaagtgactagttggtctaaatcacgggggtggcgggcaccggtgatgttgggcattaggccgtgatgccttggaacagtacatagcacggaccggttggacattcaagggttgtgattgacggctgggcccgcaacgtgacgtgcgcgatttttgagccgacagctaccggtgacagcgatacgcaccagtagccggttgcactggtactagcgtgattgagccacgccgtagaatcctaattcatcatttcgaacccatctttcagaggtgccgatgatcagtcagggttgccatgaactcttaatttatattaagattatttgcaactcggatatttaaccaatataatgtttataatataggcattgagtcgaattcgtgatgatcatgcaattatgatcgaagcgcggttaagcaacattgattagcagcatggttaatcgatggaaataaggggagaatctacgtgaatatcgggatatttacagacacatactatccacaagtgagtggggtcgcaacgtcaatcaaggtgttacgcaatcaactcgaacgggctggtcatcaagtctatatctttacgaccacggatccccatgttgataagaatatttatgaacgcaatatttttcgttttacgagtattccatttgtttcgttcacagatcggcgaattgccgtccgcggactttttaaagcctaccaggtcgccaaagacctcggcttggatattgtccatacgcagacagaattctcgatggggatgattggtaaatttgttgccaaacaattaaaagtcccatgtattcatacttaccacacaatgtatgaggattacttgcattatattgcgaatggtaagttgttaaagccctaccatgttaaggaagccacacgggcgtattgctatcatttgaacggtattgtggcgcccagtgagcgggttgctaatacgctgacggggtatggtgttaaagcgccgattcgcattattccgactggaatcgacattaatcagtatgaacaacagtcgacggccgattatcggcaaaaactgggctaccagccagatacgccagtcttgctgtctttgagccgtctggcctatgagaagaatatccatgaagtcattgcggcgttaccggcaatcttagaacaggtgcccaatgcccagctcctgattgtgggcgatggcccggcacgtgaaacactggaaaaccaagttcaagacgctggattaacggcacacgtgcaatttactggtgaaatcgataatgatgaagtctataactattatcagatggcggacttgttcgtttcagcttctaactcagaatcacaagggctgacgtacattgaagcaatggcggcaggccttaaaacggtcgtggcggctagtccgtacacggaccaattactcgacgacccgtcactagggacgacttttaccagtgaggccaatttggtcaaggatgtggtacgttatttacaacatcccaacacttttaacgatcccaagccacggcagaagaagctttaccagatttccgcggagtattttggcaagcaagtcatcaattactatcaagacgtgcagctggcgtattctgaatcagcggataaatcggcgaatattagcaattaacgggcgtcaagccaccaatgagcaccgccaaatttgggatgcttattcggcgtatgacgcgtaaggggacgaattatgttagacattaccatgttttcaaaagctgactccgtcaagggtcagggagtcggcagcgcctatctagaattgatgcggttgttgcggacccattggcaggatgaatttaatattaaagtcaatcgatatgggcgctccgccgtttcacattaccatacggttaatccaatgttttacctgtctacgtttatgcctaatcgaggccgtaaaatcggttacgtgcatttcttaccagagacgctcgagggtagcttgaagttgccacgaccattccaaatgattttcaatcgttatttaatctcattttataagcggatggaccacattgtggtggtgaacccgactttcattccaaaattggaagcataccatatcaaaagagcagatgtaacgtatattccgaattttgtcagcaaacgtgaattttacgaaatgactaaggctaaacagttgcgcttgcgccaacaatacggctatgatcaaagtaaattcatgattatcgggaccggtcagattcaggatcggaaaggtgttcctgattttattacgcttgcaaagcagaatccagatatccagtttgtatgggccggtgggttctcgtttggtcgaattacggatggttaccaggagttaaagcgggtggtcgataatccgccagctaatctgtcgtttccgggcatcgttcctcgcgagaagttagtcgactactataatatggccgaccttttcttactgccttcttataacgagttatttccgatgtccgtattggaggccttcagttgtgggacaccagttttgcttcgggatttagatttataccgggcaatcattgatggctactaccagtcggccagcgacgttgatgatatgcaacaacagatcgaccggttacgccataatccagctgggttgcagttcttacacgataaggccgttttggctgctcaggattattcggaagagcgtcttgccaaggtttggcatgacttttatttgcaacaggcaaaagaggggtagtcaatgacaagaaaaaacatctggtcattactcgtaatggttgcgttaggcgtcggcatttcgtggtactcactgcgcaatgtcaaactaagcaatctaatggacgatattctcactttgaattggtggtggttattagttgcgttagggtgtgtcggactatacttcggtctggaagccgtggtggtgcaaaagtttgtcaggtaccgttatcggaactatcgctttaagagtgccctgcgcgttcctttagccgagcaactattcaacggtatcaccccgttttcttcgggtggccaacctgcccaaatcttcgtgatggcacaatcagggattgacgctgggcgagcaagttcagttgcattgatgaagtttgttgtttttcaggccatggtggtattgaatttcttatttgccatgttaattggttttcattacttagctgaaaagttaagttacctgtcactatacgttttgttaggttttctgattcactttgcggtgattgttggtctgttgctggtgatgtactggtacaactttacaaaacgagcggtgaagatcgtcttgatcccggtcagctggtttatgaaagctgagcgatttgccaagttcgaaaacaatattagtgaaaaaatcgattcgttctacgaagaaagcgttcgaatgaccaaggactggcggatgctggtcgaagtttgtatcgtcaccttcttacagctactgttttactacctgattccgtattttattatgcgggcaatgggaatcgatgatgttaatttgattatggtgactagtttgaacgtgttgatcttcttagtgacatcactattcccgattccaggtggggccggtggtgctgaatttggtttcacggcgctgtttgctaagttcattcccagccacagtaagctgattttagcgatgctgatctggcggatcttaacgtattatttaggactattcttagggatgatcgccatggcgatgcggcctgaaaaagcagaagaaattccgattgcggcacctagccggtcggattcacaagaacagtaattttaatgggccgacaccattgttcgacccatttttcgcggttacgaattaaaggaaggtactatgttaaagttaatcaaacaacggttggtatggggattagtgttgacggcggtagtcggcgggctattgagtcgcaatctaacggcgcacgcgaccagtagtaaggcggatgaggtcaaagccgcctatgtggtggatgcgaagtccggtcaagccgtttacgcgcagaatgccgatcagaaattacccattgcgtccctgagtaagctcatgacgctgtacttagtcgaacgggccatcgaacgtggtcaaatcaagtggacggatacggtcccgattcgtaaaaacgttcgcaagatggcgaccagtgcaactttgtccgtgatgccgatgccggctaaggagacgtttacggtcaaggaactgttcgcagctaccctggtagggtcgtcgaatagcggtgccattgcgctgggcgagtacgttgccggcagtaatgataagttcattaaactaatgaatcagcaagcggccaagtggcacctggatgcgagttttgtgagtgcttcggggctcgataataccgatttgaagaattatgatttaaaactcaaaggaaccagcgatcaggaccaaaatctcgtgtcagcacgggccgtaacgaccatcgcgcaacatctgattgatgattaccccgacgtgatcaaggttgccaatcaacgttcggtcaagattcacaagtatacggtcccaacatcagtggaaatcctcaagggtgccgattattatgatccccgagttccggtcgatggcttgaagaccggctatactaatcaagcgggtgcctgtctagtcgccacttaccggcagaatggccgccgaatgattgccacaacgcttggtggtgcgtggcagtttacggcgaacaataacttgcgactgatgctcaaaaagaccgaacagtacaagcaggtcgttcctaagcacatcaattatcagattccggggacgcacactaaagtacggctagtgacgaagtacgactcaaagctgtgggtcaaccaggatcaaccgatgacccagactaaaattgccttgtggccattacaccgggcagcgccgaattatctggccgctaatacggccgtgctaaagttgcggttgacggatccattgtcaggaacgacgaaggaattcatttatcggacgcctgaagcgctgacgatgctcgggccactccaatgggctacgacaccagccaaacgggccacgacgcccgcgggggcctacgcgttcgccaagtaatgcgagctaatgccagtggtgatcatgggacgttgaagataagtaaaggagcgctaactaccgtaatttacgagtagttggcgctccttttttgttgaactcaatgcggtcattgtaatgactagcagtgatgaacgagatctgttaggtgttgaactagcgttgcatagccccgtgataaggtcgttgcttagttgacacggttagcaggctcttgcatatacgcggtgagacgatccatggcctggcggagtttttccatgctagcggcgtaacttagccgtacgtagccttcaccctcggcaccgaacccagttcctggaatgattgcgagctgatttttgcgtgccaaatccttacagaatgccatcgagtcttgctcaaagcccgctggaatcttcgcaaagatatagaaggccccagtcggacgcgcaatcttgaagccaagcttcgacatcgtttgataaacgaaatcacgccgggcttggtactcttgccgcattggttgcgcatcatcgattccgttggtgagggcttcgacaccggccttctgtgcaatcgtggttgctgcagtgacgtagtactggtggacctttttaagttgggccgtcatttctttggaagcaaataggaagccgatccgccagccggtcatggcgtgagacttcgataagccgttgatcaggataacttcatcagggatgaacttagcaatcgagacgtggtcgctaccgtaagtcagttcgctgtaaatttcatcagagacgacccacaagttatggcggtggaagcagtcggcgagcgctttgatctcatcttcaacgtaagtgacaccagtagggttgttcgggtagttcaagacgatgcccttgaagttctcgtcaggatgcgccgcaataaagtcgtcgaccatcttaggcgtgatgacaaagtcgttaacgcccgtatccatgaagagcggtttagcgtgtgcttcttgaatgatgggaatgtacgctggaaagattggggacggaatgataatggcgtcgccaggattacagattgtcgtcaacgcagtcgcaatcgcttccgtcgctcccacggtcactaagacttggtcttcagcatcgtaatggacaccgtacttggtctcctggaagtgggcggccgcttggcgtagctccaacagccccgccatgccagtatagtgagagtagttgtcatcaatcgcctttttagccgcggctttaacgtgctccggcgtgttgaaatcgggttcaccgagcgttaacttgaccatatcggggatcgcactgacctcttcgtcaaactggcggatggttgaaacttgaatgtgactgatggtttcattgagatcgtctctaaatagtgtcatatatccgaactcctttaatttataagttgttctaattttagcacaacttctcaccgtcttagcaggaagttagggtataattataagtgtgaaagtttgtggtaaaaatgggctttctactaaaaaaacgtgttattagtcctattttttgctagaatgtaaacaaaacttgaaggagcgagattagtataatggataaatctgaactatcagcaattctcaaacgactagaagccatgcgcacaactgaagcaaccgaagtgcaatcacggcggttcgaaaaggaaggtgttcaacgtgggcaagtagcgtatgatcccgctacctcgacgtacacgttacaagaattcaatccagaccaaacgtttgaatttgataacattgacctcgtggcaattgaattatacgatttgctaacggataactagattcccccaaaatccagatagattttcgatagatccatattatgacgcgttgtaatgttgaagaatttttgaagaaatcttcaagatattgctaactagtacgcaaccgttataatatggatttgttaatagcaataacggaggaagaaattaccatgcctaaatttataaaaaacacggttgggaaggtcaacacaacgttgggcttttacctcctaaccgtggtcttattttggctaaagacatatatcgcttataagagcgagtttactttaggggttaagggacccgttcaggaatttatcttgttcttgaatccatttccgacagcgatcgtgctgctcggtattgccctatatttccggggtcgcttaaaatattggattatgatgatcattgacgccctacagacgacgtggttatttgccaatatcttgtactaccgggaattttctgattttatgtcggcaggggtaattaagagttccggtgctgctagtaataacctcggaaagagtttggggcagattattcacgggaccgacttcttagtttatgcggatgtcgtgttgctgattctgttattagccttcaaggtcattcggatcgatccgcgacctttcaaaattcggtatgcggcaacactgaccatgattggggtggcgttgtttgctgttgacctcggcatgtctgaacatgaccggtcggatttgttgacgcggacgtttgataacaactacatcgttaagtacttgggactcaacacatatgcagggtatagtttttatcagactgaaaaagaaagtgcgacgcgggcccaagcaagtagtagtgatatgaagagtgtgctagcctacctcaagaaaaaccaggctggcgagaacgttaagtactttggtaaggccaagggtaagaacgttttcgtgattcacttggaaagtttccagcaatttttaattgattataaggtcgatggtaaggaagttaccccgaacctgaacaagttctatcatgataagagtactttgagttttgataatttctaccatcaagtggcgcaagggaagacctctgatgctgaaatgatgatggaaaactctttgtttggtttaccaaccgggtcagcgatgacgcagtatgggacgtcgaacacgttccaggcagcgccagcaatcctgtcacaaaagggctatacgactgcggctttccacggtgatgtggctagtttctggaatcgggataacgcgtataagtcgtgggggtataactacttcttctactcttcttactataaagagaagtcagactacaatattggttatggcttgaaggataaaatcttcttcaaagactctgttaagtatttggagcaattaccacaaccattctacgcaaagctgattacgttgacgaaccactatccatacgaattggataagaagaaccagtcgatcgataagacgacgaccggggattcaaccgttgatggctacgttcaaacggcccattatcttgatcaagcctttgccgaattcattagttacttgaagaaggccggcttatataagaatagtatgattgtgctttatggagatcattatgggatttcaaacaaccataaggctgccattgcacagttattgggtaaaaagtcggtaacgagtttcgacttggctcaattccagaaagtaccatttatgattcattctgaaggaatcaagggtggtattaaccacacgtatggtggtgaaattgatgcgttgccaacgatttttgacctgttagggatcaagaacaagggttacatccagttcggaacggacttactgtcgaaacagcataaccagacagtggctttccggaacggggattttgtctcaccgacatatacgaagatcagtgggacagtctatgattcgaagaccggtaagaaactgacggatatgacgacgaagcagaaggataccgtcaagcagatgcaaaatcacgtgacgacggaactctcgctctctgaccgggtcatccaaggggacttactacggttctacacgcctaaagggtttaagaaggtcgataagtcggattacagttataagctgactaagaccctcaaatcactgaaagagattcaagctgagaagaagaccagtgttctttcgaagcataagggtaaatcaaccgaaagtctgtataagacggatgcaccagaactgtctagctcgagcgacagtagtagttcaagcagtagttctgattaatcgaatcagtatcaactaagggataacgctgacggcgttatcccttttttggttgcgaagataagttggcattggtcttggactcggtgcgagacacgattattgtgctgacagttgcgcattttggattaacactgatggtgaacgcggaagtgttaccaagtcgatggtgtgatcgactgcaatctattcttagtctcgaataaatgagacgttggaatagcaggggagcgttgtgaatcaacaacggccggtcatgatgtggggctgttgaccgtttagtcgtcttgatttggtcgattgtcaacgagataatattcattatgcgagcgttgctgtactattgaaaaacagtcgttgaaaattaaagggagatttattgaatttttgcttgctatctcgatcaaaaccccgtaaaatatagtctattgcgacattaatcggtgtttaaaacttttctgaaattaattcataaaaagggttgacccgggtcgttattcttggtattatatttcttgtcgttaagagcgatatgcaacattactcattattatgaatattcgaatcgatgtgagcatttacattgaatagttattcaaaataatttataaaaagatgttgacagcttgttctgatgatgataaactttaatagttgcgttgaggtgatttttttcgtcactcgcaactttagataacgtcaatatgacatcttaatactgcctctgatgcagtattattagagcagttgttatctgtttttataagcaactgactagttcggtaatcatgccactaacgcttgattcctcaattgttcccagataattaattaattgcatcggactcgttgcttggctgtatgtttgccaaattttccatttatcatcaaaactgattctggcaaactgtagtcgttgtctaattaagcgattaattaattttgtctgttctagtcgcttgtaattatcaaagataattagcgcatctcccgatatatgcgcctccccagatgcaccaactaagtgatacttgaagactcgatttatcggtatgattccatcaggatcatcacgctcaatactcagctgatgctgattctcatcccaagtaaacttagtgcgcgcaactttttctcctagacggtcaatcataatatatgctccgtctgtgcctgtataaatattgacgtccaaagttgtcggtaacgcttcaggagattgcatgtaatcatggtttaatggcaaaatgctcccggcttttacaaacactggatatgttgccttttcacgatacacttttaaagattgatttccacaataacagatgcctgtgaaaaagtcataccaatctccttttggtaaccaaacatcggtactagctaatccagcttgttcatctgatggtgtcgtgataggtgacacaatcatagcatccccaaatagatactcattgggtacctgatacgactgcttcgcattgggatattcataatacatcggtcgtattaacggaataccttgcttatgcgtttgataattagcactatctatatatggaatcagttgacttcgcagttgtaaaaaccgaatcatgaccggctcgattgtagcatcataattccatggttctttacccatgaagatattattagaactgtgcaatcgtaatatcggactaaatacaccgaattgtagccatcgtagtgccaattcaccatcatacacgccatgcatatgtccaccaatatcatggctccaccatgtgtagccaatattactagcagtggccgtaaaataaggttgaaattgcagagacttccaagaagctaccgtatcaccggaaaagcctactggataacgatgactaccaggacctgcatatcgtgataaaatcaatgcttgtccgggatgttgtcgttcattatcttcataatgatcaatattgagcaaccaaagcggatcaatcttcgtcttacttcgggatccaccttgctgccagtcaatccaccaaaagtcaacaccttgtttttctaattgatgatggattgtatcgaaataagctcgtttaaaatcaacatcttgcaagtcaaaaagcgcaggttgctcatgcttcacatctagtttcagttgttttgcaacttctgaatagctttcttcactgggacgaataccacttgctggatgcacattcaatgtcacttttctcccttgctcatgcaacttttctatcatgcccactggatctggaaagtagtcctgattccatgtatagccggtccaaccactaccatactttgcaggaatatccgttatatgccaattcatatcaaacaccgaaaccgcaataggtacatggtgctcatcaaaacgccgcattaaatctatatattctgactgcgtatagggataatatcgactccaccagtttcctagtgcaaagcgcggcactaatggcggaaaccccgttaattgatagtaagcatataacgtcgcttgatagtcccgaccataggcaaaataatacaagtctttttcagcatgctgacgagtagatatctggtctccttctaagataaaagactcggaatcgtctagcacgccataaccatcttttgacattaatccatcttctagttgaatttccccatctgctttatcaagcgtacgtgcagtcccttttaaattcttagatactgcctcgccgtagtaccaacggctatagtatgtgccataattattcatcgcatcaataaataggctgccggcatcgagagcaccaccatcatagtacaagtgaaaaccaggagtaataatttctaaaacgtgtccgtgttgattttcgacgacttcaaaatcaggaactccaaagtcccgattttgtacagtttgtgtatgaccatcttcaaattgattattctcagagtactcaatcctcaacattttatcagtcaaaacagtaaatcgaactttatctcctgtaatgatgtttttactaatctgcattattagactcctttgttccaactgatatcaagtaaactaccgcctcataaggtttaaggctaattttattgttgagcactgttcctacatcttcataattattaatcaacaattttgcagtttgatttcgataccgctttggaactgtccattgagtcgccactgttgcaaagctacaaacaactaacagtgtctgctcttctgtctcacgtatataagcataaatttgaggattatcagcatcaattaattggtaacgaccactagtaataatattatggtgatgtcgcaatgcaattagctgttgataaaagtaccagattgatttcgaatcagcctgagctgtagcgacattaatctctttataattgtcattaatcttcaaccaaggctgagatgtcgtgaagccagtattgcttttcgcattccattgcataggtgtccgtgcattatcccgtgacttcatgtggatcatacgcattgcctcactgactgatacgtgttcaaccttagtaagcctttcaaaaacatccttagtctcgatatcattgtaatcgtcaatatcagcataatttacattagtcataccaatttcttcaccctcataaatgtagggcgtcccctgcatcatgtgtaacagaactcctaacattttagctgatgcaacacgatacttcccatcatctccaaaacgtgaaaccgcccgagcctggtcatgattgctccaatataagctgttccatccatgatgacttgcaatcgttgtctgccaagttgataaaacacgttttaaagcaaccaattgaaaccgcttggtcgagaacttaccatattttccatagtcaagatgcatatgatcaaaatggaataccatgtctagttcttttcggcgctcatcgacatattttaccgcttcatcaactcctgtgtgtggtgtctcaccgactgtcataattggatacttttttaagacctgttcgtacatatcatgcaaatattcatgcacatgtggaccgttagccgttccaatatagtaatcaccgtatttcttattttgaataattggtccatccggatatgctggatctttcgaaatcaaattaatgacatccatccgaaaaccatcaatccccttgtctagccagaaacgcataatatcgttgactgatgcgcgaactcgaggatttgtccaattaagatctggctgttcttttgcaaacaagtgtaagtaatattgattaaatttagcgacatattcccatgctgatccaccaaagctagatccccaattattaggctcgtggccatcaactggatctttccaaatataatagtcatggtaaggattatctttagatttaagtgcctctttgaaccacctgtgcttatctgaggtgtgattgacaaccaaatctaaaataattttcaactccagtttgtgcgcctttagcaacagcttatcgaagtcgtccattgatcccagctcggtatctacttgataataatccgaaatatcatatccattatcaatatgtggtgattgataaattggattaagccagataacatccgcaccaagtgacttgatatacggtagtttctccgtgattcccttcaaatcgccataaccatcaccatctgagtctttaaagcttttaggatagacttgatatacgactgctcttttccaccaatcagtttcactattcatcatcatcatccgcttctacattaatatcattaacataagccaattgtgctctcgcttctgccaagatagcccgtgcacgctcagcaggtaagtaatcagcatcattttccataatcaatgccataattaacggcagattcattcccgtaaaaatgtgcgtatgtttacgttggtgatatgggaaaaatttctgattaacacttccggcaagcaaatcagtcacaataattacttcatcttcatcattaaagcttcccataattgtcttgacctgttcctcaatcggttgattgtcagtgtaagccgtcataatttgcacattatcatgactaccactgataaactctaacgtatgttgcatgcctgcagctaactttccatgtgaagcaataacaaaatatcttttcatgttcaatcaatccttccgatctaagcctattattaaaagagaccgcaatgcggcctcataaattcaattatttggcaacgcctaacacaccagtaaaggctcctagcaatgataatactagtaataacacgataacccgggttggcgtccatttcttactacctaataaggcataaaccatatatgctactgcggcgggtagcaatgctggcataattttatctagtactcctgtctgaatacctaaactaactttcccagtcatgaattttagcggtgtatatacctttacagctgtcgcaactaatgcccctacaacggttaaacccataacagaactagcttctgtaaaaacagatagtcggtcacccaaagtcgttaccaatttaacgccagaatcgtagcctaaatcaaacagtttaattcgaatccagaataataagatatcaacaagaatccaggcaattgcacccgtaggattcccttgcaatgccatataaccagcaatagaacccatgatagtaggcagtaagacccaaatcaatgtgtccccaattccggcaaatggacccattaaagatgttttaagtgattgaaccgcatctttagatttaattccgtccttttcttccatagctaatgtagcacctaagataatattagccattgtcgtagtagtattgaaatacttaaaatgattatccagagcttgtacatactcatcatctttgggataaatctttcgtaacacctttgaaaatgcccaaacaatcgagggcccttgttgtgtttcgtaattaaagttattcactcccataaccatgtatcggagaatagcactgtgccgctcgcgtttagtcaactttgtgtgttgttcatcattagtctttgtaacgtccttactcatcataatcatctccttgtgattgatcatcagacattgtcatcgtttcagattgagcatgcttggcattggcctctttcatgccatgctggaaaataacaattgctgctgccaatcctaacaaagcaacgccaaatactggaactttcaaataagctgcaaaaacaaaaccgacgattatatacgacacatacttcttagttggcatataatgcatcaacattccaagaccaacaacaggtagcattccacctgcaatcgttagaccattcatgatccactgtggaataatatttaaaattgctttaactgcagtaggaccaactgtgacaacaacaatcattggaatgaaatttttcagtgcaaaaaagaatggtccgagccaattaatcatgcgcatcttatcaaattctttttgatgtgcatacgcctgtgctttgtgagcgatgaagttattggctaacttgataataacgtcaaattgaatcgctaacagaccaaccggtaatccaactgcaaccgcagtagcaataccagaaccagttcgaattgctaagaaggatccaacaattgttgctaatccataatcaggaactgacgctcctcccagaccagcaacacctaatgacattaattgaaatgtccccgcaattaccatggccgtttgcatatcacccataatcaatccagcaaccaatccaactgtgactggccaataattcaaaatcgtaatgccttgattatctagcgttgcatacgaagctagaaataaaattaaaatgttttgcaaaatatgtggcatttttaaacctactttcttttagttgaactgcttaccttcaatagccttatcaaatgattcaggggcatctgttgggacatatttaatgtctacagcaaccccacgacgttgaatttcttgtaagtcagctacttcttttgcattcaacgaaacgaacttactaatcagcgtccgaccgtcttctgcaaagacgattccaatatccaacttaggaatttcaacaccagcatccattagtttcagcatcgtactaggttctttagcaattaaaaatacccgttgtgcatcataattaccattttgaaaattatgactagctttttcagtattgataattgacattcccgtcccggttggcttacttagacgcatacttgccttcaaatcttcattttgactaacttcatcatcgacaaccatataccgcttagcctgtgtctccgcggcccactggttcacgacaattccatgaattaagcgttgatcgattcttgctaatactactgacatatttgtcacactcctataaatttgttggtatttcaatttttttaccgtagggactaccttgaatacatacatctgttacatgttgacggattgttgcaacatcatccaaatcttgttgattcatataaacggttcctgcaattttatgtttattgtcttgattgaacatattccataatgtcacactggcaatttcgactccggcttcgacaagctttcgcacggctgcgggggttcggcaaacgacaaacactttaaaaggtcgtcccaacagactaaagtgttcttgctttaagcgttgaattgtcttagcaccattgtcaacgcttacaaattcaccagttaagttcgcagactggagtgccatattcatgattgttttatttaaacgatcatttacgagctgatcatctggtactactactgcgtcaaactctaatgcctgtttccacgtaactgcaatctgaccatggattaatcgattatctactcgagctacaacacttactttctcagctgccaagcatttcaccatcccttcacatttatatatgcaaaaagcgtgccaactactgttaacaattgttactagcagtagttggcacgctcatcgagcattgattaatcaacgtttgataggtcaacacggccctttagaatatcatagataaatccaatctctgacaccggaatagtgatttggtaatagtgttgaacctcatcaagagcatctaagacgatttgaataaagtgttgatggttgtgttgaaattgttctagcgagtgataatctaaattgggttcctgttgaacaatccgctcaatcatgaaacataggtgcatatataaactgattcgtaaataaacatcaaacttagatgccaaactccgctcaataattttaacgatttgttcaacctgtacgactgttttttgaggatttaacactgcaatgtttgaagcgatattgtccaaggtaaacgctcgaactagtatttgattcatcgtttctaattgttgcgtattaaacattccaggaaaagcattcataaaaacttggtttccaatctccggattgattaattcttcaacggatagatacggcgtaccagagacacctgggtcatcagttccgacaattaactttacattataccgatcaaaaatcggatcttgctgtccattctctttcaactgatgaaaatccttagtaatcacttgaatagaatctgccgttgtctgcttaacgatttgttgcagatatttcgcaccgcctacaccggttaaacacgtggtgacaattacttttgtcttttgattagcactcataactttcatttgaggtttaacctgacttgcaatatcggctaatgtctcatcagataattggttctgaagaattttctgtcctatcgataaggccatcgcagttgatacattagtcatcatcatcactttaccctcataatgatgtttaatcatttcctcaaggcgtgttaaagaccccatatcaactagtaataagagatcactctccgtgttaattgttttaaagtaacgatttagttccgtcacgacttcatcaacactggcatcaagtggcatgtccacagcctcataaactgaattatttaacaatcggttaacagtcgtggctatgcttgcagccgtagaatagccatgcgtcacaataactgcgttagtcttgataggaatcaattgttctttttgggcaaaaataaagttgaaaataaacaacttatacaaatcaggattttgcaagcttagctgattagcaatcgcttgaacaatctgttcggaaagctcatagcgttgaccaaattgttgtttggtttccagcaaagtcgtctttaattctggcacttgacgatcgtcttcaaagtcatttaaatacaacacaattagagcgagcaaatgcgagttactgttaaaccgattaaccccaaagtttaaatagaaattgcttaagacgctcttaatagtcgtttccaaaaagccaagaactgattcggcctgtggacgttttaaatcaaaagagacaaaatctgcaattctattagctgttcgaaccgttgaatcaaagtagatctttctgtcagcacttatggctaactttttactaattgaaataatctcgttcgcaaattcaaataatcgagtccgctcccgaacaacaacttctttaatttgcgacatatgataatcgattttaatcggattgattccttttgttgttatagcagcatcgactagtgtaaaatctgctggcaagtccgtaattttaatttggagtggcccgcctaacttccgctttttcaataatgcttcagcacaagtcagcttgataatactttgcaatttaccgacgtttccggctaaatccgcatttataagttgagcagtcacttccgaattaatgtcaatattgcgatttatcaaatgtgcttcattcaaaaataacgaagcaaccaaatttaacttttcttgttttgttcgactacggaagctcgggatctggataaccatgggaatccgacgcaaaaaagtttgtagaaagtcaatatttgttttttcagttgttgcgaagattaaccgagcatttgaatgagaaacagttttagtctctcctagtggccgataacttcccttatccatatactgaaacagcttctcctgactttctggtgctaatctatgaacttcatcaagaaacaaataaccatctttagcagaagctaatagcccttcacgcgctgtttccgcaccagtaaacgctcctcggacatgcccaaatagcatacttgataacagctcaggattattagcatactcggcacagttcaataccatgaacttgcctttaacaggtccttccgttagcgcaaactcataggccatcttagcaataaagcttttcccaactcccgaatcaccaactaataggcacggcatcccatttggtggataaataactgcagattttatttgattaacgacgtttttcaaactagcatctgcccctattaattttctaaatgggtccttatttgtaatacctggctggtttgaaattgccagagttccggttacctcttgaaatttttcaggattttgatcgtaagtacttctggatacaaaataaaccggacgagtattagtctttagtgcttcgccattatgaactaactcatttagatacagactaactgtactgcgttggatatctagcttatcggaaatgaattgtgcagatacgccaatagcatcaggctttaactgctgactagctacagttagcaattgaataacccgcttgcggttagtaagcataataattatcccccttgtattgcgatttaacacccagtgtaaagtaaaacgtttacaaataaaagttaaaacacagaatttgtcttatctacatatcgtcatttcaaatgattcaccattgcaaatcaacaacattaacccaaaaaactagcacccaaaccccaaccgggttcaggtgccagctttattcaacctatttaattcgtaaccgacgtcttcgtcttagctggtaacgcggtcaaaaagtggctaaagcactgcttcaagaagtgttcgctagcgtcatcagtcaaatggtcgttctcatcaaacttggtgccagcttgtggcaacatgaattcgttgccagggaggactttggcgtcaacgcctggtgagtccaggatttgacgtaagttcatttgggcgcggacggtgccttgaatacctagtgacgtaccaacaatcatgactggcttgtccttgaatgggtgttctgcacatgagagccattcgatggcactcttcaacgctgctggaatactgtgatcgtattcaggcacgccgaacacgacaccatcggctgcttcgatcttagccgctaacgccttgacacttgcaggctcttggtcgatatcgtcttcgttgaatagtggtaagtctttgatttcacagatatcaaagttaacctgggtctcgaacaaatccttcatcacgtatagtaacttgcgattataagacttggaggcgttggtccccacaattgcgacgatattggcttcatcgtcgccagctgctgcttgacgttgggcgttgtcactggcggctgcaccggcaacatagcctgatgagatgccccaggtattcatcatacttggcatcgaatcgtgaccattagcaccaccgatgatttcaccagcaccaaagtaattggcaaccggcgcatccttggtcgtaaccagttgtaagttgtctgcgttgacactgtaaccacctagcgttgtggcaaaccggtcgcgctgttcaataatgtagaaggtctgaccttcaaactggtgcaagaacttcggatcgcgtccaaattcatgatcatgaccatctttgacgtagccttgataattattgaccgtttggaccagttcatccacatcgataccagcttgtttagcggcgtcagtcaagtcgcccttgacgaagattgggcgtttgtccttgttatcgaagaagctttgaatttcttccggcgtaaagtcgtgtaaaatcaatagatcatagactttcttccaagtccgttcatccatgactaagtaagcgaccttatcatcctgcttgagaatggcattccggaaagccgtgtaaacgttggattcaataacgatccgcttccctttggaattgacgtaaatggcacccatgtccgtcgcttgcttcgaggcatacgtcgttaacttagccacgcctggttcaacttccacgccatgtggatagagcttataccagcctaaatcgtgggtttgtaggtccaaatctgcattgaattgataggcatcgcccgtcgaggtcattggaccatagtaatcgataccttcactctcttcgccgcgcatcttctggttggcaccatggccaccggcagctaggacgactgaacgcgctttgatgttgaccatttggtccttttgggcggcaacgacaccgcgtaattgcttatcattatccagcatcaacttttcgacccgcgtgtctagtaagatttgaccacccgcggcagcaaaggcttttgagaccttttgaatgaattcgtaactgcttgcggacggtaattcgatttgtcgattgatcgaatgttccggcgtttgggtctgggccttttggtaatgcaaatcagcgaacttgctgataaaatcaatggctgggccaatgttatgcaccatcaaatcagttaaggctgggtaattggtttccaagctttcacgagcgacatcttgcgctaacatctctggtgtatcgtgattgttatcaaagatttgtgcggagacatccgaaccagtcccgacaacattggaaccgttcaaaatcgtcgcgccacccaaatagccgtttttctcaactaagatgactttttgtcccatcgatagtgcgcggcagccggcaactaatcccgcttcaccaccaccgatgatcaagacgtcggtccgataattcttagtctgcggcttagccttcttagggactggatgaacggtcacgccagcatcagcaactgcctgatccgctgacttcaatagtgcttgggtcatgaccgtcgcaccactgatcgtatccacgtcgaatgactgttcagtaataatattttgcttcaacttatcgatgacttggttaaaaatccccgacgtttcggaatgttttaatatcttcaagtcctcaatcttattgtcttgtacgtccacttcataattgatgataccgttgtggcccattgcctgtccggtaatttgttttttactcaatagtaaacactcctttgcgtcgcggcgttaagccactggtaactgtgacgtgttggtcgtggtcaatgaagatggcctctgtcttaggaagcggctcaatcagcttagctcccagctttgggccttcaaaataggccacggtcgacaacacttctgctaattctgactgttcagtaataatcgtcacttgatcaacttgattttccaccggataacccgttttcgggtcaagaatgtggtgatattggcgattgccaatcttaaaatagcgctcaaaaatccccgaggtaacgaccgtccgtgctggcatctcaacttgtaacgctggatagccacgtggcgcttctggggcctgaattccgacctgccaccgttgatcagcggtcagtggattgtccccgaggagcttcacgttgccacctaagttaacgatggcgtgttcgatacccgcctgttgtaattgcgtcacgatttgatcagcaaaataccccttggcgattgcgcctaagtccagctgcatgccgggttggcgtaaatacacgctagattgcgcttcatctaaaatcacctcatgcaagtccattagagctaaccgttgctggatttcttcagcggacggtacctgatggccgccaaagccaatcttccatagtttgactaacggtccaatcagaacgttaaaactagtcggatactgttgcgtatagcgaatcgcatccgctactaaccgaaagcacgcggtactgaccagtaccggatggatcccggcatagcgattgatcgcggccacttccgaatcaggacgattgaccgagaagacctcatccattcgttgcaagtaatcatagacggcctcaaccgccgtttggttcggttcaaagagggtcagcgagataacggtacccatcatcgtaaattgcgagacatatttcttgtgcgtttccatcatcctgctgaccccacttgtttatcgttagtttatttaatcgcttaattcaatttcaagtcttctagttctgggcgtaggtgcgctaaggcaatctggcccggcgctgaagcagcaccgaccgtggcaaatgagagacacgatccaaaggcttcgcccgcgatccgtgaaactttacctaagtcacccatcgacatcgtaatcacaggccgtgacaacgtttgatgggcgatattggtggcggtcagtagtgtcaacacatcttcagcagattgcggcatgacagccatcttagcgacatccgcgccatattccaccatgctagtcaatcgtttgacgatctccgcagcattcggcgtcttgtcaaaatcatgattactcatgataacgacgaccttagctgcctgagcttgcacgaccaactgcttaacgtccttttcttcatgatagcgttcaacatccaacgcatcagtgaactttccagcgatcaccgcttggcacaccttgaagtagtcagcgtcggctaaggccaattcaccgccttcacccttcgtccgaaacgtcgtcagcaaggcaatatcgcctaacgcgttccgcagttgctggccagcatcctgtaacttagcggtatccgtaacaccgtcaaagaaatcaatgcgccattcaactaagtccggcttagcggccttaatcggatcaactgcactcagaatatccgcgaccgtcttacccgtgatgggcaccgcgattttgggacggccggtgcctaattcgatgtttcgtaatttaatgactggttgcatctcgcgcacctcctgttatcaataacttgttatttagcgtcatcgtcactaaataaaatttggtggatataatcaactggcatatcctcacctgtccacagtttaaacgcagcggcaccttgttcgagcatcatgcctaatccgttataaacgtgctttaatccagcttgacgtgcaaccttcatcagcttagttgtccgtggcgcgtagacggtatcaaacacgatttggtctggacggaaccaacttggatcatcaactaatgtcttgtcttcaagtggcttcatacccaccccggttgaatcggtgtaaatatatgaactctgaatttcttgcttaaaatcatcacgatcttcgagtgagtgcaaggttgcatgacaatccgtctgttcattaattagtttaacgtttcgtaccgcatttgcccacgttgcatcgtgcatattaaagatcgacatttctttgaccccgtctaaggccgcttgaaccgcgatggcagtcccagcaccaccggcacctgacaatgtcatcttgtgcccacgaatatctaatccttcgtcagttagcgctttcataaatccgataccatcagtcgtatatccagtcaacacaccatcatcattaacgatcgtattaactgcgcctaccatcttggcagctgggtctaacttatcaagcagtggaatgactttttgcttgttgggcattgaaatattggagccgcgcatgtctaaagtccggattgattcaatggcacttggtaacgtctcattcgtgacttcaaatgctaagtaggcataattcaagcctaacttagcaaaagcattattgtgcatagttggtgacattgaatgtctaatcggatatgccattaaaccaatcagtattgtatgtccatcaattcgttctgtcataaaaaacactcctcaatttattttcgggtttgttactcaattcacttgttatgttagcaaaatagtttaatataataaatatggatgattcgtttaaatcatcaaatttttctatgaataaaggagcgtcctaaccatgaatttaaggcatttaattttcttcaaagagttggctcgaactcaacatatggcaaaagcggcggaaaatcttggcatttcacagccctcactcagttatgcgatcaaaaagctcgaacatgaattgggcgttcccctattcgaagctgacggtcgtaatatcaagttaacgtccattggtggcgtctatttgaagtacgttaccgctactttaaatgatttatcacaaggtaatgaactcgttaagcaactgatggatcctgatactgggcacgtcaaattggggtttacgtacacgcttggccagcaattagtcccagaattaatgtctaactttaaaaacgagcctagaaatcaagccatcacctttgaactgggccaagggaattctcagggattactgcaagcattagcgaatgagcactatgatattgttctggcctccaacgtgcgaaagcttggcgaccagttcacagcccacctctttgactttattccattagtccaacaagaaatcgttgccgtgatgccaaatgaccatccactggccaaaagcgactcactccacgtcgctgatttagcagcttacccgatgattcaattttcaaaaaatagtgggttgcgcccattaattgaccaaattctggcggccgcccacgttcagcctaaagtggcttacgaagttgaagaagatcacaccatggcgggtttcgttcggtacaagctcggcgttgcactaatgccctatttaccgctattaaatcctagtcaggtttgcatcaagcacttggttgatcagccacttaatcaccagatttatctgatcgttcgccgtagcggattcgtcacgccagccgtgcaccgttttcaggaatttgcacgcagctattgttggcaacattatactgaccaggaccgattaatctaaaaattgcgccctcatcacaaagacgcaattttaatcttaattttcaacactagaggccgtcgagacagctgatgattggccacgatacttaacaatcaaggctaatccgacaccgattagtgtaatcacaacgttcattaagataatcattcttggcgcactggctcccgtgacctttgtcaaatatgcggccgcagataatacgacgtaattagcgacactggaagcaatcatgaccaatgatgtggccaagcctttgctgtccgggaagaacccaatcgtcgttgaagtggcaagttggagcacacctccagcggcggcataaccaatcacgaagctcccaatgtacaaaataacgggattactgatgaagtagcacaatagtaacatgacgattgaaatacttggatataggaccaacactgtcgtttctttcaagcccatatggatgaactgggccgtcaaaagtacggcgaccgtcgccccaacagcatagaatgattgtaaggtacttgggtccttgatgccgtagctcgcgcctaattcttgattacagttgagccagatcatgaaggtggcagaacttgtaaagccgattaaaatcgaggcaattgaagctggcgtaaaacgatgcttcgatccactcttattcgtcgttgattgcgtcttaacggccgtcttatcttgttgtggaaacggcaaaatcagcactaagattgcatcggcaatcattagaatcccgcaaccaatgaagatgactttatatgataactgtgcgcttgcaactaatccaatgacaaatggcagaatgaattgggccaccgtaatcgcaaattttgtaaacaggttcgcaattgaagcggacttagggaagatttccatcacacttggtgagacacaagtgtccaaaaatgagttggcaatcccattgacgataccaatcgcataagcccaccacatactatggacactaatcatgccgaagaagaagacggcatacaacgcgatgccgataaaaccactgattcgacgaccaatcttatctgagacgggacccgcaaatggataagcaatgagacgtccgagaccatatgctgcaattactgaaacaaccatactaacatcgatcgtgccattggctagcgttgtcgcaccccaagccttcgcaaaatctgtcttgtactgtcccataattgaggaagcaatccccaaaatgaagtaggcaaaataaagtgctagggccgtgacatagtatttacggttcgaatttgtattagttgccattttaacgacccccatcatctgagaagaaccgcttcgtcacttcttcaactggcatttcttgaccagtgtatagtttgaaggcagctgcaccttgccagaccaacatgccttttccgccaatcgtttgactaccctgtgctgcggcatccgccaacattttagtagttgctggattatagacggtatcggtcacgactaaatctgagcggtaaacactcatgtctttaatattggtttgatcgatattcggggccattccggctttagtcgcattagctaaaatctcactctgactaatcgcttgagccaatgccgcctgatcattaatatcaccgaccgtcacctgacaagctggaactttcttcatgatcttttgtgcggtcaattccgcattttgataaaagtcatccttggggttaaaaatgtgaattgcttgtgcaccatccagcgccatttgaaccgcaatcgcagtagccgcgccgccagcacctaaaacagtaagtcgtttccctttaggatcaacgccgtgatgccgcagattttcaacgtaaccagcaccatccgtgttatggccgaccaagacaccatcattgttaacaattgtgttcacagcaccaatcaactcagcagctggtgaaagttcgtcaactaattctgctgcgactttcttacacggcatcgtcacattggcaccacgcatattcaacacgcgcatcttagtcaacgcactcgccatctcatcagcttgaatatcaaatgctaaataagcgtcgttaattcctgcttgttcaaaactataattatacattgctggagaaccagaatggcctacaggtgagccaaacagtcctaacatcgtcgtatgaccgtcaatccttgcttccattagttaatcctcctcagtgttgcttggcaactttcttcgcttcgtatgcttggtattcggctgttggcatattcttacccgtaaagagcttgtaggctgcgtcgccttgccataacaacatccctttacctggtgccaccgtgcagcctaacgcttcagcgtcttcaattagcttggtcttcagtggattataaacggtatctgcaacgactaagtctgaacgcaaatagctcggatcaaccaatgattgaccgtctagtggtttcatgccaacaatcgtggcgttgactaagatatcagcatcttcaatttcggcttttaatttatcctgatcctcaagatggtagacgttaacgtcaacttccggcttagcttctttaatcttttgttgtgtcttttcagcattggcataaaaatcatcatcacgattgaagattgtcaatgacttcgcaccatctaaagcacactggacttgcaaggcagtcgccgcaccaccagcgccaattacaactaacttcttaccggcaacatccacgccattttctttcaaattacggacaaacccgataccatcggtaatatgccccgttaatttgccattatcattcacaataacgttgatagcgcctacaattttggctgctggcgataaatcatcgaccagcgtcgcggcaacacttttacatggcatcgtcacattactaccgcgaactttaaatagccgtaacgcatcgattgcttcaggcatctgctcttttttaacatcaaacgcgagataagcataatctagtccttgttgttgaaagctgaaattatacattgctggcgagcctgagtggccaacgggtgacccaagcaacgtaaataaaccggttgttcctgaaatgcgcttttccataattataatctcctcgtctattgaataaggaaagagactgagacagttgtcccagtctcatccacaagttcatgtaactgaatcaaatcattattttttcgctggttgatgatgatcgattgcgtattgacgacggccacctggctttggaatcatgtcggaaatcatgatattcaaaccaccatcgacagtgacttcaccgccattagtgtaatcagaacgatcactagccatgaataacactgtattggcgatgtcatccaaagtcccgatacgacgactagcaactaagcgttcccgaccttcttcaactttaggatcactatagaagttttctgataacggcgtcttaactaagcatggtaggacacagttactccgaacaccgtattgtccccattcagcggccatctgcttcgacatcatattaaccgctgccttagtcgtactataagcaccactataagtttctggataacgtgaagcgaccgttgaaatgtgaaccattgtgccgtgcttttgttgaatcatgacacgaccgaaacgttgtgacatcaagaaataacccgttaagttaacatttaaagctgcttgccattcatctaatcgtagatcttcaagtggtgagaaacgtaagattgcagccgtgttaactaaaacgtcaatctttccgaatttgtctgtaactgctttaaccgcagcgtcgacttcttcttcattagtggtattgcacttaactgccaatgtctcgacaccatacttgtcggcaagtgctttagcatgttcttgagtcttatcctcaagcatatcgattaaaacgatcttggcactttgctttgcgaattcctcacaaaacttagttcccataccaccgacagcacctgtaattgcaaccactttatctgttaatcctagccaattgttagtcattagtactcgctccttctactcaattattaagcctgaactggatcttttaaaatttctggccaagcttgcttcaaaactgacacagtttgcttatacgtataatccgcaacgtagtcaattcccttggccatgtactgatccgaaataacctcaacaccaatcaccttaggatcgacgccagcgtccttgatcatttttacgaaaccagctgtgtctaagtcaccagcacctggtgccaaccgatcatgcattgattcatcacgtaagatggaagttgcgtatggccgggtgtaagcatcgtcaatttgaattgaaataactcgcttagcctgttccttagttaataaatcatatggttggttagcgcgaacccagtgccacatgtctaataacatgtaaacattgtcacagttagctttctgcatgattttccaagtcttatccaagtttggcaaaccactgtatggcattggttctagcgcaatgatcaaatcacctgcacgcgcagccagttcttgtaatttcttggctgtataatcaatatcataatcttccatcaaaccagtattgatgtgcttgacaccaaacagttcgcacatatggaagcaagcttgttccttatacttttgttcatatgaccgttggggttcacaccactgaacaatgtattcaacttccgtacaacgaatctggtatttatttaaaatgttcaaaatatcctgatctgttaagccttcattcaaagcatcaacataagtttcagcgcgtaagccgatgccatcataaccagcagcacttgcagccttacaacgatcttcaaatgtacattgatcacccagcgtccaggaactaattgtaattggatgtgcttttgtcataatatttttcctccaaggatagtggattcgtaacatgcatgttctgtgattcacataatttattttacaagttaaatgtaatcgctatcagtaaaaacgtccaattgcttttatccaccataaatcatagctaaaagttatcaattctggtatattagccttagaacaaagtttctaatacccgtcagtcactaacaagttgaagtttcagggggtcagaagaatcatgaatctggatcatctacgttatttcgtcgcactttctcaaacagaaaactatacacaaactgccaagctgttacatattacacaacccagtctcaccaaggccatccattcattggaagccgagctcaatgtcgcactctttcaaaaatccgggcgtagcgtcacattgacacctgccggcaaggtcttcgctaacgatgtcgaatccgcgctattacttttagacaagagcgtcactaacgtcaaacggttcaatcagcaaaaatctcccatccgaattgccgcactcagaacgctcagtattaagtggctaccagatatggcgcaacggtttcttcaattaagtccccattcggccgtgcagtttcagttcaataccgataccggtctctcccctgatattttgcggggactccgcgataagaagtatgacgtggcgttttgttccaagctcgatcacttcagcgatatcgatttcttcccagtcgctgagcaaacgatggtctgtatcacgcccaccaatcacccgttggccaatcgttccagcattaatctcgcggaaacactggcttatcctcaaattacattttcagagcgtagtgggttgcaccctatcatgaaaaaactcttcaatgactgtggcggacaaccaattagcgcatacacggtcgaagaagatcaagccatcgccggattagtcgctagtggttttggcattgcaatcgttccaaacatgtcgattcttcaaaacatgcccgtcaaaatcatccccttatcattcccaacttggcaacgaatcttatacatggcagttttaaaacatcgcacgccacagcccgcaatggaagaattcattaaatttgtccgagatcagagtaaaaccttatccgttaataacatctaaacaacaatcaaaaaatcgcatccaaccgatagcttcaggctattgattgaatgcgattttgttattagacacttgtcgtagccgtgttaaaatttgaagtgaatcaatgattgtgaatttagtatcaatcataaattttataagatgtaaatcgtttacttgtctgtcttaacgtcatttacaatctggtcattcagccttaggataactgtttaaaaccgttaattcagccaagtttgtgaaaaatagaattggtgggtgacaaccatggaattgaaagaaaagcaggatataaccatgaagcataaaacgtacttaccgctagctgctggaatttacttaaattacgccattttagggatggcgaccattatcgtctcgcaatatggcagtcaattccaagccctatggcacaccgatgttaaaggaatctccactgtgatcgccatgattgggattggtcgcctcttaacgatcctgattgccggctacctctctgatcggctaggacgcaaaggcacgatgctgattggcatggttgcgcaaattctattcttagctggcttattcttcagcaccaatctcattagcgcctgcattgctgcactatttatgggtgccactaattcctttggcgataccgcaagttacccggcactaactgatgcctttcaggagcaagccgctagcatgaattcactcgtcaaagcggcgatgtcactggcgcaattcgtgttaccatttatcgtcgcagcacagccaaatgcgcaaatcacgctggtcatcatggtcgtggtgatggtcttagacattgtcttgattgccctggcaagctttgcaccgcaaacattgacccaagcacacgctaaaaacgagcctcagagtcaagcgctgaacactccaactaattctaatgcggcacagccgtctatgttgatcgatggcagtctcttgatcatcgtgggattcacgttgtcatttacattttatattttctcgcagtatgcacccaacttcggaagtagcgttctaaaactcggactcaatagttccaagtcattgatttcctggtatgcgatggcctcattgatctctgtctttattacgtcatccttagtcacacgcatcaaaccaatcaaattgatttttgcctacacgttaatctcattcttagcattgttacaaatggtcgtgattcccagcgctgacggtgctcgtttgaccgctattgcaatcggcttcttcgctgctggtggaatctggcaactgggactaaccttactcagccaatatttcccggccgaaaaaggcaaagtgaccgggtattatagcttcgcgactgccctaacgttctttgtcgggccattggtctcaagcttcattattgatgacacggccgctagcgtattacatgtctttgaaattgacacgggcgttaccttactcagtcttgtaatcgttatcattctgatgattcgtaatcggaaatttgcagactaaatcatggttgataaagcaagtgtgactctgaaaagatgtctaatagaattcggcaccgtggcactggttctgaaatgatgccgaatggcgttcgaaatcagagcatgcgctttgaacctaatcatgctagaagacaacttagtagactagatttaaatgaataggacgagtaacccaaatcggttactcgccctattttagtgtgtcgtgactatttatcccacgcacaccagctgttgatactacgcccgcacgctcacgataatctgtaccaataccatcaacgccgccaaaatatctaacacccagccactccagatataatagttctccatcggacggtatttttgacgtgtgactttgaggttcttttcatagagtcgattgaaaaatacaaatagccaaataaagaaccataaaatcaagcaaaagacgggataaataaaaatattgcttttaattccccacggctccaaactcgtgaccgcggttggcacatagactttaccaggtaacaacggataggcgattaccgctaacagtagcggtactagtgctaaaatcgtctgtccccataaattataatgaccatgctcatccttaatattaaacacatgcccaacctcccttgattaaccagtgtattgcatacggcaattgctggttccacagttgccaatcatgatgtcctgcttgtgagtgccattcaaaccgctctttgaaaacagcagctaattgtggtctaaatgcttcatccatggcgtttaaaatatcttgatcaccggtcgtcattaagactcgcaacgttccccagtcggttgaatgctgtaataaatattgtaagtcaacagccgtgttccgtagttgttccggtgaaaacgccaaatcaaaatcgggcatgatgtcggcttgttccacgtgaaacttttttaaatctgttaccggcgacaatgccgccaccgctgcaaactgttgcggataggtcaacgcatagcgtagtgctccatacccgcccattgaattgcctaacaaatagttgtcagctggccgcgcagataacgggaaaatgtaacgcattcgagtgggtagctcacgtgttaagtagtcccaataccgtggcccatgcgccatatttgtgtaaaaaccccgaccggtctccggcatcaccactgcgacccgatactgcgtcgctaacaattcaatggccgtccgccgtatccaggacgtggcatcgccacccaatccatgcaacagccaaatggttggtaagcgctggtctccactcatataagccgattggacttgtccagccgcatttaaaggttccggtaaaatcacctggacctgtgcaggctgccgtaagatatttgaataaaaattattactatgaattgacatgtgctcctcctatcaatgcccaatcaacgaatttgattcattgccaccgactttgaatcactgctcaatctaagtccaaagtaattcggtagcatataactgatggtatattccagcgtctgatcaccttgaaagacccatcgctcaattttgataatcatcgtatctaggccaacatgcaggtagtccgccacgcgctgatcaggaacacaggtagccgcatactcttgttcaaacggctgtcttgagaggtcaagttgcgaatgcttgcgaatcaaagcatagatcgaatggactgctcttaactttttaagtgcacctgccggaatcagtgaggataagtaccatgattgggagaactcaaacggagcccgcttcatttcgcgtaatcgctctaagtaccaagttgccaccggctcagcgaatcttgcacgtgcgggtggcacagtctcttgattggcgacgagtacggcgacctgttcctcatcaacatcataaggatgcgtgtccgtgattcgtactgcagtgccccgattaaacttggacacgaagcttccctttccttgaattcggtaaatatacccttggtcagctagtgtattcaagacgcgcacgaccgtcgttgaactaacctgatacttctttcgtaattcactctcgctataaaatggcgcgttcttgcgaaaatgatttgaattcagctccaagatcaatgcatttaaaatagtttgataaattggttctttccgactcattacccttcaccatcccgctttagcaagttaatgcattaaatgtctatacttaatcaaaatttaggcctattcgttacaaataacgttatgaaagcgttaactatactgctatattatgctatactcactgttgaaatcaagttaatgcattaacttttttgaaattaggggggataatttacaactacttgaaccaaccaaactttttaaggagatgaatgaatcatggataattcacgtacgtggaaagataaaacggttgacgtcatgagtaaaattgcagccaaccgttatttacgtgctattcgggacgggatggcggttattattccagttaccatcgtcggctcgttctttacgatcgtcacgcaactacccattactgcttggacaaactttattaagccctacgccgctggtttagcaattccaattaatttttcaatgggctttatggcgatttatgcggcatttgccattgcaggtcggttagctgaagattaccacttcgaccatatttcaaccggggtcgtctcagtaatggtcttcctattgttagcggtcaaaccaattacgaccacgcccgctgctttcaaagcactgggcttaaaggccgctgcgaccgtggtgccattaacacacttcggggctgccggtttatttacagcgatgcttgccgggattctaacagccgaagtcactcggctctgtcgtgatcatcatctggtcatcacgttaccagatggggtcccaccggctgttgccgcttcattctcagctttgattccagcgaccttcttaatcgttggcgcttgggtcattcacgttgggttgaattttgacgttaacgcgttcttacaatgggtcttcagtccattagcctactttgggcgtgacaatttgatctcagttatcgttccaatcctcttaaccgatattgtctggttattcgggattcacggtgccgctttggccaccccaatcttctggccattatggtatccaaacctgaacgaaaacttagctgctatttctaagggcgctactgcagcaacggttccacacttcatgactgaacaattcttccaatggttcgtctacgttggtggtgccggtgcaacactgtctctgtgtatcctattaaccttcttctctaagtcgacttatggcaagacaattggaagggttaccattattcctgggatcttcaacattaacgaacccgttatctttggtgtgccgattgtgatgaacccgtacttcgccattccattcgttctggcaccattgagcatggggattattacttgggcagcaaccgttctccacttagttagtcggacggtcgcattagtgccttggacacttcctggaccaattggggcattgatgacaaccgcttgggactggcgtgctgccgtcctatgtattattaatattattgtcgccactttcatctactacccattcttcaagatttgggatcgtaaacaattaaaggctgaacaagacgctgctaaagccgatgctgaaaaagcagctccagcagccgttgccgaataatagattgcacaaaaatcacacggatttgttattacggtatgcttaaactaacgactactttcaatgaacatgattgcttatttgctgacaatcggtctgactttagcgccaaccgtaattagccattatgatcatgattctgggaggactgctgcattggccgcagtcctctttgtacatattctaagaaacgagggaaaacgattgaaatctaatattaaccaacttactactgagggtcgtaaccctgccagtaacgacttagacgaaatgtcgatcctagcaattgcccagttaatgaatcaagaagatgctaaagtcagtcaaagcatcacacccgaactaccacaaattgccgctgctattgcccttatcgtcactgcctttaaagctaacggccgcttaatttacatgggcgctggtactagcggtcgcctaggcgttttagacgctgctgaatgtgtcccaacatttggtactgaaccagagatggttcaaggactcattgctggcggggatcaagctatgacggtcgccgttgaaggtgctgaggataatcctaatttaggcgcacaagacttgaaagatctggccttaactgctaatgatgccgtggtcggcctggcagcaagtggtcgcacaccttatgttatcggtgcactggactacgcacaacaaattggtgcggcgacgatcagtctagcctgcaataatcaggcactaatcagtcaacacgctcaggttgccattgaagtaacccccggccctgaagttctcgctggttcaacacgtttgaaagctggcacggcagaaaagatggtccttaacatgctatcgacaatttcgatggccaagatcggcaaagtttaccataacttgatggtggacgttaaaccaactaacgaaaaactcgtgattcgcgcgaaacacatgatcgaactggccaccggagtttctgccgatgaagccagcgaactattcactgccgctcatcaaaacgttaagacagcgattgtcatgaacttggctggggtctctgtcagcgacgccgagcagcgtttacagcgcgcacacggtgtcgttcgtgacgcactcgcactgcaatgaggaggtctaaaatgacatatttaattggcgttgactgtggtggcacgcacatcgttggtcaaacttggacgacagcccccgagcatctagtccaaagcgttacgggtggccctggtaacgttgtcctaggctactctgctgccgttactaacttaaccactgtcttagaccagctcactgccgcaattccagctagtcagcttgggttgattttaatcggaattgctggcattgaaactgctggccgggctgatcaggtccaacaaaccatcacccaacgttaccacgctaatacccaggtcataagcgatgcaaaactggccttactgaacggtcttgcaggagcagacggcgccttagtgattgccggcacgggctcggtcgtttatggccgccaagccgggaaatttctgcgcgttggcggctggggttacgttttaggtgacgaaggcagtgcctacgacattagcaagcgggcacttaaacaggttctgacccagactgataacggtcaaactagtcaactaacagctcccctattggcacaacttaaagttaccgatgttgctgccgccgtccagaaattttacgctcaagatcgacaaactaacgctcaattagcacagttaatcgccaaactggccgagcaacaaaattctgaagccatcacggtattagtcacgtcagcccaagcactggcacaacaagtcgttaccttatatcagcggtttgcagagcctcggccacaacgggtcgccctttctggttccgttttacaacacaatcgcctggtccgcgacacgttaacagcgacagtgcaccagtcaataccaacaattgcatttaacgatattacaactaacaacgcccacgccgtcatctattggcaccggtggactcaggaggaaattaattcatgacaatgcgtcaactaggtttatccatttatcccgatcatagcgactttgaagaaaacgccgcttatctcaaattaggccaacactacggcttcactcgaatttttatgagcatgctggaagtatctggtacggtcgccgaaaccaaagctaagtaccagaaaatcattgacgttggaaatcagttgggttaccaaacgattttggacgtttcaccacggatttttaaacaactaggaatttcctataaagatctaaagttcttcgctgatttacacgtcgccggtattcgactagatgagggtttcgatggcgcaaccgaggcgctgctctcatataatccgtacggtctgattatcgagcttaatatgagtaatgacgtcgattatctgaataatattctcagctaccaagcaaacgtcccatttatttatggctgccataatttctatccccaagttggcaccgcgctaccttatgactttttcgttaagtgtagcgaacgttttcgcaagttcggtattcacaccgctgctttcgtagccagtcaggttggtacgatggggccatggaacgtcaacgatggtctgccaacattagaagctgatcggcgcttaccaatcgccgtccaagccaagcatctcttcgcttccggactaatcgacgatgtaattatcggtaacgcttatgcgagtgaagccgaactggccgcattatcagcaatcaatcggtaccaagtacaatttcacattgaatttgaagctcagacgaatgcgatcgaaagaaccattgccttgaccccacaacattttcgccgtggcgatattaacccaaatgtcatccgttcaaccatgccccgtgtgacctacaaggaaacgcccaacagtccacacgataatgatatagaatttcagcgtggcgacgtattagtaggcaacgacaacttcggcatttataaaaatgaattgcaaatcgtcttacaaccccactgtgaaccccgaaagaatcggattggtcggattgcacctgaggaactgttactgcttgactttattaagccttggagtaaattccggtttgtggattgaaattaagtttcctgttaaagaatcataaaatccgctcgaagtttggagaagacttcgggcagatttttggtctatgtgcgatcaagccattgatactctactgatttgatcatttttaaaatactaaacttaccggcctcttcgctttgattaattagataatatgtggctcgtcccttgtaaactaatttttcaaatttaaatcaaattcaaggatgcgtataaaatatgcatcggcaagaagatcttttgaatctcaaatataaatcaaaagaattgacagatttacaaaagtgaatcacaacactgattgatgcctaatcactcacgattactattcggtaatggttctgcatgctcacgaaactggactggtgagaagcctgtcttcttacgaaataaccgactaaagtaatgtggatcttcatacccgactttattagcaatcgctgttaccgtgtattgtaatgttaaattacgaagcaactcttgtgctttttgaatccgatactctattaaatattcagaaaatgttcggccatatgtctgtttaagttgcctgctcaaatacccctcatttacaaataacgcacttgcaacctgacttagtgaaagacccttttcagaataatgcgtctcgatataatctttaacattcatcgctagactacgggaagtaccttcatccacaaccgtacgtttatcggttattaagcattgctggaacgcaatcatcaattttttcaaatcagatcgtgggattggttttaataaataatctagaaccttcaacttaatagcgcgacgtgcaaaatcaaaatcatcaaaaccacttataatgacaattagcatatcagggtaacgtcgattaatcagttcaattaaatctaatccattcatatctccaaggttgatatcaactaacgcagctgaaaccgcatgttgatctatataacttaacgcttgatgccccccactggcagttattatctcatcaaatggcgattgaattgactttaaatatcccgccaagccacaacgtaatgctttttcatcatcaataatcagcaatctcttcatcacagttcacccccatgttcaatggattcttcaaccaacggtaatattaccctgacagtagtctggcgcctcgtactactaaaatcgagtcgtgcttgaccattgtagatcaactgtaatcggtgtcgaatattataaataccgtaactattttttcccgcttgatagctcccgtcattgagtttttggaccagcttcgccgacatgggctgcccattattgctgaccgttaattgtaatcgtgttggcgatattaatgcaccgccgattcgcaattcattattaccatttggactacatcgtaaaccgtgattaatggcattctcaaccagcggctgtaaaataaaatgcatgacgggttgatccatcaggccgtcatcaatatcaattgatagttgatgtaactttggaaaacgaatcgcctgaatcttaaaataactctggacatgggtgatttcatttcttagcgttgtatactcacatccatggttaagtcccttccggaaaaaaatacttaagttttcaatcatcgtaattgcagtatccgtatcaccacctaaaatctgccattgaattgtatccaatgtgttatataaaaaatgtggctgaatctgcgcttgcaatacttgaatagtcgcctcgcgatatttagtctcattttcataaacgcgatctaaggtctgattaaaggtcgtcgccaaggtttgaatctcttggggaccttcaaccactgctcgaatatcatggccgccgatttgaatttgattcattgttcgagttaagttttcaatcggtcgtacaatttgtcgtaataataaaactaataacaatcctaataaggcgattacgactaaaacgataatcaataataatcgaatgagttgttgtgtattttctcgtagctctttcttctgtacaacataattcaccttccaccgtggcaactgttccagcttggtcgtgagcagtagttcacgttgcggattaattcgtggagaatcagtatcaccacctaataacatcccagtaccgtcatagattgatagctcatgtgcaagggcctccacctttgctaacggaattgcagccgcaacataagccgtatgatccgctagtggtcgtgccaaccgatataaaataataacaatcgactgatgatcttccttggaagttagcaagttactaaccgtatatcctcgttgaggataacgttgcatttctcgatagtacgaccgttgttggacagaaaagcttggatgagaattggaataagaaattccgtcacgtgatacgagtcgaatcgaaacataattgtgcttatcaaatttcgtaagcgctttagtttctttgaataattgttgccgattataatcgtgttgtgccggcaaattagcaagcaacctcagttccgataatcgttctccaaaccagctatcaatttggtttccacgctcgtcaaccatttgttgtgtcatttttgtattaatcggcatgatatttcgagccaattccatacgcatggcaccataaatcgtaccgataagtgttaccgatattaatataaataaccaaacaatttgtttcttaattgaatacatcctaattcccccatcactatccaagctccgtggttctatcatctttcacttgtacattatttcactatttagttataaaagtccaccttatctcctaaaagtccaacgtctaaaatacaaataacacgtatactaatactattaaatatctatttcggaggtcttagtatgaaaaagagatggtggggtatcattttcacaattgtctcaattttcttcttaacagcttgttcagcaagtgatgagtcgcaaactgttaatgggaccggcactggaaaacacggcaatatcaaggtagcagttacctttaagggggactctattaaagatatcaaggttctcaagcagaacgaaaacaaagtgttatctaagccggtatatagccagttgaaagatacgattgtcgcaaaaaattcaactggtgtggatgttgtaagtggttccacagcaactagtaaagggtatattgctgcagtcaatgatgcagttaaaaaagcaggaatttcactcaaaaaagtaaaagcaaaaacgagcactacggaacctaagattgctaaaaccaataattatgatgttgtcgttgtaggttccggcggtggagggtttgcagccgcaatcgaagcaaaacaagccggtaagaaggttgcaattattgaaaagatgccgacagttggtggtaataccttaatatctggcggtgaaatgaacgcacctggtaactgggttcaaaaaaggctcggtattaagggtgattctgtagcaagctactataaagatacaatgaagggtggagacaaccttggtgacccagcaatggttcacattctcgccaataatgctttgggatcagccaagtggctccgtgatgatattcacgtcaagtttttaaacgatcaactatttcaatttggtggccacagttacaaaagagcactgattccagttggacatactggtcaggaattagtcaccaagttaaacgctaaagccaaatccttaaatatcccaatttacgtcaatatgagagccaaatctttaattaaaaaaaatggacgaattaccggcgttaaagcacagtaccggggtaaacgaaacattacttttaaagctaaaaatgccgttatcttaacaactggcggtttcggttcaaacgttaagatgcgtactaaatacaataaagagtttgataaacgctataagtccaccgatacagccggaacaaccggagatggtatcatcatggcccaacaagccggggccaagcttactaatatgaaatacattcagacctacccgattgctaacccgaaaaccggtatgatttcattactagctgatactcggttcgatggtgcaatcttagttaatcaaaaagggcaacgctttgtcgaagaacttgaacgtcgcgacgttatctcaaaagccatcctaaaacaacctggtggctatacgtatcagatttggaacgacaaaatcgatggtatttcaaaaacaaaagccgctcataaggcggaatacaacgagttaatcaaagaacacctactctataaagcagacacaattgatgaattagcaaaagatgttaatatggatcctgctgctttaaaagcaacaattaccaaagtcaacagctatgccaaaacaggcaacgataaagactttcatcaccgcgctggcctagtatccttagctaaagggccctactatattgaaaaggccgtgccatctgttcatcatacaatgggtggcctagtgattaataaacagactcaagtcctcaacactgatggtcagaccatccctggattatacgctgctggcgaactaactggcgttattcaaggttcaaatcgccttggtggtaacgcgatcgctgatattatcacctttggacgcattgcaggtaaaacggttggtaagctttagtttgttcgacaatcatctgaaaaagccacaagttacaattaatcatttctaattaaaaacgcacgaccggaatttttgccaatccggtcgtgcgtttttaattatgcaaatatctcaggattacttggcctgctttgtcagcccattatgcttaatcacatcttgataccagtagaacgacttcttgggatagcgagctaacgtcccgtggccctgatcatctaggtccacgtaaataaagccataccgcttactcatctcgccagttgatgcactaacaaggtcgatgcaaccccatggtgtgtagcccatcaaatcgacgccatcatcaatggcaccagccatcgcttcaatatgttgcttcaaataatcaatgcgataatcatcttcaacatagaaattcttatcaggtttatcaatcgcacctaggccattttcaaccacaaacaacggtttctgatagcgatcatatagctcatttaacgcaatccgtaacccggttgggtcaatctgccaaccccagtcactcgccttcaaaaatggattcttgacgccgcccatcaggttaccagcaacagtatcggttacactacccgtggtttctaccgcgctcgacatataataactaaacccaatataatcaactggatattgttgtagtaatgccaagtcgccatctgtggtctccagatcatcaaaggtcagattatattcagccagcagtcgcttggtataggtcggataagctccacgtacttgaacatccgcacagaagaagttgaaatcttgattatgctgcaaattagccagctggttaactgggttcgaatcataagcataactagtggcatagagaatcatacagccaacctgaatatcgtctcgcaattcgtgggcgattttgactgccttagcactggccacaaactgattgtgccatgcctgaaaaacgttctttttgtcattagcacccgtcgatggcactaatccttggcccatcaccggaaaatgtgccgcactattgatttcgttgaaggtcatccaatacttaacctttgaagcataacgcgttaagatggtccgcgcgaaagtttcgtagaattcaatcaaataccggttcttccagccaccataccgtttggccaagttcaatggcaattcataatgtgagattgtaatcactggttcaatattattggccaagcattcgtcaatcacatcatcataaaactttaatccggcttcgttaggttgcgtttcatcaccgtttggaaaaattcgtgaccatgcaattgagaaacgataacacttgaaacccatttcggcaaacagtgcaatatcttctttgtaatgatgatagaaatcaataccttcatggttcggataggtgtacttatctgtatcgatcgtccagtcaaaatctggttgactaacgattttaaatcggtctttgccacctggtaacgcatccgcaatcgataagccacgaccaccttcttggtagccaccttctaactggttggcagcagtcgcgccgccccatagaaatccttctgggaactctgacatttaatcaacaccctttctagttagctaataatgatagcccttacaacaagtataatcaatcattggtctgaatatcaattattaataactatcccaaatcttccccattcgaagcaattactttcttataccagtcaaatgagtctttcttcatccgtttcaaactaccattaccttcatcatcttgatcgacatagatgaagccataccgcttagacatttcggaggtaccggcactaatgacatcaatgcaaccccaggtcgtgtagcccatcaaatcaacaccatccttgactgcttctttcatctgttcaatatgttgacgtaagtagtcaatccgataatcatcatgaatcttaccatcggcgctgatttcatcttcggcacccaagccgttctcaacaacgaataatggtactcgataacgatcccagaactcgttcaaggtaatccgtaaaccaactgggtcaatctgccagccccaggcactggatttcaagtatggatttttaccacccattgataagttaccactggcttgttcaacatcatcagtcgccgaagtaatcgtcgtcatatagtaactaaaacttaagtaatcgaccttgccttcagctaacaattgttcatcgccagcttccatcgttaattcaatcccgttttctgcaaagtaccggttcatatattctggatattcaccacgtacctgtacgtcagtaaagaacaaattcaattgatcttgcaattgggccgcccgaacatcagctggattaggagtattggcataagtttgcatccgcgcaagcattgagccaatttgggcctcaggatcaatctcgtgacactgcttgactgcaattgcacttgcaacaaactcatgatgtagcgcttggtagcgtaattgcatttgatcatgtaagcttagatcactatcaattgcaccagtaccagtaaatccccaagttgaagcgttaatttcattgaacgttagccagtacttcacaacacccttatagcgtttaaatagcacttcagtatagcgagtgaaatctgcaattgtcttgcgacttgcccagccattattcgttaatgttaggtttaatggcatttcatagtgggaaatggtcactaggggctcaataccatacttgtgacattcagcaaaaacattgtcataaaacttcaaaccagcttcattaggttcagtttcatcacctttaggaaagacccgagcccatgctaaggatagtcggtataccttgaagcccatttccgcgaatagcttaatatcttccttgtagtgatgatagaagtcgacgccacggcgcttaggatagagcttatccgtttgatcatcaatggcagcttggacactctctttagtaacctcgttcatcgacattactttgcggtcagtagccttctgaacaacttcagcagttgttaggcccttcccatcaacgttccaacccccttcaacttggttggcagcagtcgcgccgccccacaaaaagttctttggaaagccagttggcattgtttttgaatacataattgaaaactccctttaattagtttaattgtaataatggttcagttgcattaacttccgtagcagctggaaaagccagtttaacgtcatgatagttcttagaattagtcacgaccattggcgttgtaacgggataccctgccgccttaatcgcttcaatatcaaacttcactagcggctgaccagctttgaccgtctcgcccttttgaactagcgtttcaaaacctttaccctctaattcgacagtatccattccaatatgcatcaagatttcagcaccatctgttgtgtttaaaccaacggcatgtccagttgggaacacgagtgctacttcgccgtcagctggagcgtataagacaccatcagttggttcgattgcaacacctttgcccattgcacctgatgagaagacctcatccttaacttcacttagtgggatgatttggcccgtttcggggctacttaacttagtggccgcattgtaagtgacgtttggttctactttagttgctgcaccagttggtgtcgtttctactgaaacaccaccgacaatgactggatcagcagttgccgcagtttctacgaccttagtttgcttgtcattactatcaacactcttgtaaccaaataacatttgtagggcaaaaccaaggactgcagcaatggccatcgcaataattaagccatatacagagccgtctaccccagttttagaattaatcgcagctgggattgagaataatcccataccgcccatcatatacatttttgtacctgcaaaaccaataataccgccaccaattgaagcggccacacaactcagaataaatgggcgcttacgtggcaatgttaacccataaatggcaggctccgtaacaccgaaaataccggagataaaggctggtaaagcaataccgcgtgtcttttgatttttcgtttgtaatagaatgcctaatacaactccagtttgggcaaacgaagcggctaatgataatcctaaaatagggtcaaagccttgtgaggctaggttggccatcataacagctacgaacccccagtgaacaccaaagataacgaaaacttgccagaaagcacccatcacaagcccagcaacgatcggactgaagttatagattgcaacacacactgttgaaataccatcacttaaccaacttgcaactggtccaataattaaaaaggtaatcggcactgcgattaataacgtaataaatgggactaagaacgtcttaactaccgttggcacgattcgttttgcaaatgcctgaactttagatgcaaaccaaacggccaagataattggaattactgaagaagtatagctcatcatcacaactggaatacctaagaaagtcgcgtgaatctgtgattcaaaaatactgccactgaacagcgtgcttaatactgttttactgctgttcaaagcgacgatacttggataacaaagtgccatcccaatcgccattccgacaaattgatcaacatgaaactttttggctgctgtcaatcccaaaacaattggtaggaaatagaagaaaccatcaccgatcgagtagagaatcttgtatgttcctgaattctctgacaaccaattgaacgcgacaaacatcgcaacgaaccctttgatcatcccagccgcacataaaacacctaacatcggcgtaaaaataccagaaatcaaatcgatgaaccggtcaaagatactcatcttttccccgtcttcataatcatcaggtacactaccaccatcggcaaaaccaccgacgcgaatgagcgtttcataaacgtctgcaacttcatttccaatgactacttggtactgaccaccggactgaacaactgtaataacaccatctgtatcttttaattcatcagtatgggtagcgctttcatctttgagcttaaaccgcaaacgggttgtgcagtgaaccacgctcttaacattatccttaccgccaactccggcgataatctttttacttaaatcttcataagccatcattgttcctcctcatttatctataaatcaataattgcaatttgagtaaacaaaaacccaaatgtcctttcttcaaaccatgccactagggccctagtgactgctgctctcaagaaaagatatttgggttaatgcctgcataaccagtaacacaccgttaataatcttatttattcacttttttgtcggtgggtgacgcgccagatgtgaagggtcaaatagactttgtcgtccggctctagtcgccagccagccttactttgtaaaaatgtatcgatccgctccactgttgcataggcatgcgcatattttacttgcatcaactgcagtaatgactgatctaattcactcccagttcaattactgcggctaacgcgttgcaccattagcgcacgtaaatgcgcaatgaaacgattgtaattgaaggactctgggtccagatgcatctggtattgatattgcacgatatcaatgatgccactgatcaatttcgtaattttaatcgtttcctgcaacttggaaccatctgaaccagcattgatgaagtgataagtcataaaaaccacttcacttttaggaaggatcacgtccgccgtcacattaactaaatcgaccgcttgactggctgcgtgaaactccttagggaacaattttttaacttcccaacggactgtaccgttatcgacatcgattccatcattggctcgcttcaacgcaaaatcaatgtggtctgcaagcacaaagtactgataatcactaaaactgaccttcaacagcggctccactaggtgaaccacctttgttgtaatcacaaaagactgaggtttcaaatcctgaaagtcatcaatatcaacattctgtttcaaagttgccacgaaacgccgctgaattttctgatcatcaatctgatcaccctgatgcttaccaaaacctacaccgttaccaactacaatccattcaacatcctgatcatctaccactaaagcggcattattattgaagttctttagaaatttcaccactcacgcctcctggattttcaaacaaaaaacctacttaaagagtatcacatctcactgaagagactgtgaatacagatatgagtaggtttatgcctgatcgaatcagtaacacgctttaatttatgttatttatactagcaacaattgtaagcggtgtcaaccgtatgtgaatattttttttgtcctacttccatctggtcaattcgctataatccttcatcatccgctacgggcgccttgcaatacatcatattcttttccagccactaccactgctaacggtaagccagtgacaagcttaacttgcgttttatcttgatatagttgaacttctagcactcgaccacgaaaacgcaaccgataactaagatgcgttatctgagttggtaaatgattggtaatgtgtaacttaccgtcagcgacatacatcccagcaaatccatacgttaatcccaaccaactgccgcccagatttgcttcatgaagcccatctttggcattaccttgtagatcaaccaaatccattaacgatgtatccatataataactgaacgccttatcatgatcacctagtcggctcgccaaaatactgaaaatcgatcgtgataaagaggaatcatgcgtcgtaattggttcatagtactcgtaatctcgccgcaattgttccagtgattgatcttctggaaacaacatttccgctaataacgtatctgcctgcttgttgacccggtgccgatagatcattagtggatgataatgtaacaacaacggatattgcgttgctgccgtcgtcgcaaagggccacaccggcatcttcggtgaatcatcatcttgtgcggtgacttgctgttcttgatcatacggtaagtacatattcgtgcttgcctttgtgaactgcgcttgctcatcagcatcaccgtcaatataatgattttccagtagccaagcggcaaaggccatattttccttagccatccgattcgtgtagtaattattatctactaaggcggtatattcatctggccccgtcactttgtataagcagaactgcgaccgaccgtcacgctgttgccagctaccaaactgcaaccagaagcgtgcggtttctaggacaaccgccgcaccctgttcccgcaagaagtcctgatcattagtgacatcaaagtataacttgaccgtatgcgcaatgtccgcattgatgtgatattgcgcagtgccagcaggaaaataagcactcgcttcttcaccattaatcgttcgccatgcgtacaatgcgccccgtgtcacacccaagctccgcgcccgctctcgagcttgtggcaagatactaaaccgataatgcaacagttgtttagcgatttgtggctgcgtatagatgaagaacggtaacatatacatctcagtatcccagaagtaatggccttcatatcccggtccagtaattcctttagctgcaatgttcgttagcccgttacgaccagctgattggaataactggaacaagttatattgaatcccagtttgtaactttttatcactaatttgcacttgcgactgttgccaaaaatccgctaaaatctgccgattgcgatccacaatatcgttggtccaactcgttatcgtatctggaagcgctcgattgatttcactgatttgacgcgtaaacgaccagctcaacgttgcctgcgcttcgatggtaccactgccatgaaaaccagtatgatcgccatatacttcaaaaccggccggaaagctggtcaaccgatcacgttgcgttatttgttggtgtgttgaagctaccaacgtctgccactctatttgctgctgacgatcagctggtataaattggttggttaacccagattgtcgttgcgctactcgtggatcatcagcgtctgacgtcgttgcagtcacatcatgaatgaccggccgcgtaaaccgcaacgttcccgtataatcaagcgaagtcagttcatagttcaagaatagttgatgtgaattatccaacgcaatcattgatttaacgaccagtttaaaatgatggtggtcgcgggtaacaatctgaaacttttccgttaacacgcccgtattaaaatcaagaacagcatcatcaaccgtcaaagcccaatcatccggaatctcagaactagcctgatcagttgcaaagtctaagtaccgcgggcttgttaatgaaataatcgtttgatgatttttcgcatatccataggcactttctccatatgtgattggattcgtcgcataaaagccattgatgagcatcactggtagcgttgcctgttgactacctgtaaacggcactgagtcccgaacacccatgtgaccatcacccaaagcaaaaatcgtctccaggtactgccgagtcgtcgttgccacatcttttaatgttaacttatcaatttgcatagtctcccccactttcgacttcatttgctgtagtataacatctgaaataaagcgatttcatcgatttaagaaccactttggtgcttttcgcatgaaacaatcgcttagtaccgacaatatactaacgttaataaagctaaatttaaagtaactgaataagctcactgtaactaaaaaaattcgctagcctgacaatcaagttcccgattgtcaagctaacgaagctaaaactactgcttacactttaatagttgcaacactctcacgttcaaccaatgtgactgggactaaccgcgtggcagattttccaaccaaacaattaacacttttaataccaatctggacaaaattctgggtaacacttgtcaacgcaggagtcgcaatatcgcagatgagcgttccatcaatgctgacaacagaaagcgccccaggtagcttcacattactctcctgagcagccttctgtaacccggccgccgtcatatcactagctgcaacaaccccagtaatgcccaattcttgataagcattaaaaacattgtaaccagcctggtaactataatctccgggttgcacccactcagcttgcccatgaatcgaataatcttttaatgccgcttgatacccagcaagccgttgactacctgtatgataatggtcgattccggctaggccaattgttcgatgaccatgcgaaattaaatactctgtcgccaaataggctgcctgataattgtcagagctaacagatttgacgcgttcatctgcaagattgatcgaaacaaagcaaaacgatgtctttgattctgttaataattgtaagtctgctttatctggttcaatcgccattaacaaaatacctgaaacagtacgttccaaagcggtcacaattgcttgatgttgtaactcggtattccgattaccagcatatagaataataacctgtaacccgatctcagtcgcgcgctgttgaataccatcaataattccatttgaaaaattcgtgggcgtgacattgacgataacggcaattacgtccgtcttctttttaactaattccatggctagtgtatttttccgatagccaagatccttagcaacttttaatatacgctcctgagtcttgtcgctatatgtaccttgttttttcgccaacacccgtgacactgtagcaattgaaaagccagttttggcggcaatatctttgattgttggcttcatttttccagctcccctccgacttaaattaattatagcgctaaaagccggtaaaatcaccgttgttagagtaaacgtttactttattgtcaaaacagtattgtaaacgtttacgttaagtgctagtattgccctgttgaaaagtgattaacttttaaggagatggattctcatgaaccaacctgcagtacactcgaataaaccaatcgctgatgtttccagtaagcctaagacatccactattgctaattcgctgcccaacctcccattaaaaaccatctttgcaattacctttggtttttgtggggttaatatggccttctcattacaatcatcacagatgagccggattttccagaccattggcgctgatccgaccaaactaggactcttcttcattctgccaccattggctggattattcgtccagccactagtcggcaaatattctgatcgaacttggacgcgtttcggtcgtagaatgccctacttactattcagcgcaccattagcggcgctggtcatggtgttattaccaaatgctggttcattcggcttcggctacgcttcaactgctgcattactatttggtgctattgctatcttatttatggatttatcaagtaatgtttgcatgcaaccgttccgcatgattattggggatatggttaatgaaaatcagaaagacaaagcgtggtcttggcaacaagctttcagtaacttaggaggcgtacttgctactattctaccgttcgttctaacttactttggcgttgcgaatacggcacaaaaaggcgttgttcccctttctgtaagaattgcgttttatattggtgccattattttattaggcatctcagcatatactattcatacggttaaggaatatgatcctgacacgtacgcactttatcatcatatcgatcctgaacaacataagcacaccaaacctatttggcaattagtaaaagaagccccgaaagctttctgggaagttgccctcgttcaactatttgcctggattggtattcaatatatgtggacttatactactggtgctatcgccgaaaacgtttggcacacaactaatgctgcttcggctggctatcaagctgccggtaattggtatggaatcttgaccttcattcaatcaatggccgccgttctatatggtttcttagttctttcacggactaatccatacaagcgaaagttttggtatcgctttggcttagctagcttcgcagttggcctcgtttgggtattcttcattcacaaccagtacctattaattgcaccattctgtttaatcggtatcggcttctttacggtgcacgtcgaaccctttaatatctttacttcttcactagatggtgccaatgaaggctcatatattggaatttttaacggtacgatttgcttgccacaaattctcgcatccgttgccagcttcatggtctttaaattcgttggtaattcgatgcctggaatgatgcttattgctggtatctcaatgttcatcgcggtacttgccattagtattattaagcaagacaagcctcaagaagatttgtcagagaatccaactaaataaaagtcattttactaaggagtgttttttaatatgagtgcattaccaagttacacacagaacggccaaacgattacgtttgctttcgcccaaccattacaattaactattgttacgccggaaatcatccgcgtctttattaatcgcggtgagcaaggtgaatcctatgcaattgagggtcataaaattcaggcgactgatttcactattgaaagtgctggtgatcattacattatccggacatcagctttaacgattcacctcgattccgaacggcatcttgatacctttgataaagatggcaatgctttgattaccgattatcgtggtgaacgcattcacttgaaaggtgtcgacaaagtccatgaacgattagttgaggcagaaggccattcagtgactaaggcacctactaaatctgatcaaggttactacgaaatcattaaatcgctagcacctgatgaatatctttatggacttggtgacaagaccggatatctaaacaaacgtggttttgcctatgataattggaacgttgataaccccgctccccagctggagatcctacctaatatttacaagtcaatcccagtgatgttggggctaaaaaatggacatccttacggtatcttcttcgacaatacctaccagagccatttagatatgggtaaggaaagcaaccattactacttttattcagctgtccaaggtaacctcgactactacattattggtggtaccacgttaaaagacattgtcaccaattacacctacttaactggtcgaacgccactacctcaaaagtggacgctcggttatcaacaatcacggtggggttacagtgctagtcaagaagaagtgcaagcaattgcagatagccttgcaaagtacgacttaccatgcgatgcgattcactttgacgtcgattacatggatggttatcgggtcttcacctgggacaaggataaataccagggtaatcccaagaagtttattaccaagttgaaccaacaggggctaaaggttattccaatcatcgatcccggtgttaaacaagattctgactatcacatttatgccgagggtcttaaaaaaggctatttcgttaaatctgctgatggtgatgtctatattaataaagtatggccaggtaacgctgcttttccagacttcggtcgtccagaagttcgtcagtggtgggctaacaacggtaaatttttaactgatttaggtgtcgctggtatttggattgatatgaacgaacccgctacgttcgaaggtccaattccagatgacgcggtctttaatgaccaagacacgccttcaacacataagaagatgcataacgtttatggccataatatggctaaagcaacctacaccggactaaaagagcaaactggcaatcgaccatttgtcatcacacgggcagcttacgccggaactcagaaatactcgactgtttggaccggtgacaaccgcagtatgtggccacatatccaaatgatgatcccacaactctgcaatctaggattaagtggctttagttttactggaactgacattggtggctttgcctcagacacgacatctgaattactgacacggtggattgaaggggcaattttcagtccactgttacggaaccatgcagcattagggactcgccaacaagaaccatgggcatttggcgagccaacgttaaacatttatcgcaagtatctcaaattgcgttatcgtctgattccttatctatacgatttatttgctaaggaaaccaaaactggcttaccaattatgcgtcccgttgtcttaaactacgatcaggacccacgtgtacgcgacttgaatgacgaatacatggttggtgacgacatactagtcgcccccgttgttcaaaaatctcaatttaagcggctagtttatttaccagctgggaactggattgacttttggaacggggctgagtatgccggcaatcaggatattgtagtcgatactccactcgacaaactaccattatttgtaaaacaaaacaccattttgccatggggacccgctgttagccacattagcgatgagccgttgaaagcgatgacgtttagagtatttggtactcaagggacctaccaacattatcaagataatggacgtgactttaagtatcaatcgggtgaatggaacaattacacaattaccgttgatcacaacaaggttaatgtgcagctcactcatcacggttatcaaccagtttatcagcagatcacggttgaattgtctgatcacattgttaaactcacttacgataatgacagtagctgttatcgagaatagtagcttaatattttaatccttaactttaataaacaccttaggataccaatcactcctaaggtgtttattatttcaattactattggatatattaacgtgctcttttcctaaataaacttgtcagtaatatcttaatgtctatccagtcgctcaaattaatccccttattcaaaacatgatcatataaaatttggtaaaaatgtattttagtaggtatttcaagcatctcataactattatgttttctatcaattaaacccaacttaccatcgagtttaacatgataacttatatcatctagtgtcatattaacagcaatgccagccattggaacttactctgaaaaaagtgatacataaaagaggaaatcaactgataaataaactgacttcctcttttaaccaattttaactattatagtagtggcttttagttaactgcatagtattgtgcttctgatcgtaatggataagaaattaattcagtcgtatccaagtgctcatggtttaaactgacactgttaatttgactattgtcataagttctatagtaataaactcccttgtccatatcacaacaagaagaatagattgtatattcgtactttccgtcagtaacttcacatagccctttttgttgttctacagaccctagtatatggaaaaactgactaacactgccactctctgtctgcatcggcaacgagtttaatttagtaaaagcggctctgacaaatctagacattgaggacaagtctccaggtaatcctagtccgcccattcctctactataactatctaaatccactttttccgaaaaactattttgaggtgtgctatttgataaggcacgatagttgttcaaattaaataattggtagtcaaaattaggattgtttgttaacacacctactggattgtcgtaaatttttagtccttctttaacactttcaataactatcgattcctgtttatcagcaaccaaccaatgtagcggtgataatggtaattgttcactaaaattaatattaaccaagtttagtttttgtatgttctttttcacttctctaacacttgaaaattgtcccaataaccaaggaattaattcaaatggtgtgatattaactttatcagcatcatattttttataatcagcataacctgcaaaatttaatcccgcaatacacaagcctttttcattcatcgcatcgtagtaaagtggatagctttctacatcagcagtaattccaattattgcataatggtgatctaagttctccaccttacgaaatactagtggatattttctaggcgtaatcgtaaccatttcattgtatgaaatttcataatcgaaatttctaccgaagtaattattataagattgataagttatggcagtacacataaatagtaatcctcctcgaaaataatatttagatttgataagccaataagcttacatctttttagtataatatcattgctgaaaaaataaagtttttttcatgaaatcatctctaaaataatttaatctattccaaacactttaagagtcaataatcaattgtaacccttatagccgatataacaatgctgttatacctacttatccttatctcgtgatttcttcaatagcctttgcaaccccatcatgttcattatcgacagttatttcatcagccacttgcttcacttcaggaatagcgttgcccatcgctactccatgtcctgcaaacttaatcatgctcaaatcattagcttcatcaccaattgccatcacattggcagcagtcaaacttaacttttcacagagtacttgcaaagcgttgcccttactaacaccattagtgttggcctcgtaataaaatggtgcacttttcgtgaaagtaacctgctttttcaacggttcaaatagtttttgctgcttaatggcagcgtctaaaacttcgggttcatcaacgtacatcgatttaatcagtttaatattccgcatctcttctggcgtccgatatgagatacccattgaaacgagattagcttcatagagtgtataatcaccaatattacggtcggccgtatacagccgatcctcagataccgcgtgaaaatgcaagcgtaacttacgtgctagggcttccaagtcaatataatcttcataactaatcggtcgttcatcaatcagttcgccactagttgtgtaggttgcagcaccgccaaaacatacaacgtattgatcatcttgagcatcgagttccaactcctgcaacaatgctttaacacctgttaatggccgtcccgtgcagataaccactttaatcctcttttctttcgccattttaatcgcttgcttaactcgcaatgtcacctgcttttttgaattaactagtgtgccatcgatatcaatcgcaatcatcttaatattttccatcatagccatcctcattctttatcgaacacgaaatagaaaccgagcaacgccccgtttctatttcttcaatagttattttaatttcagataagtattcacaacattagttacattaaagccatacttatcaagtaccaagtcaccaggtgccgaagtgccgaagcgatccacaccgatcttagcaccatgatcgccagcatactgatcccagccaaatgttgatccagcttcaattgtcacccttcttgtgaccgcgctcggaagcacactagcgcgatattctggtgattgttgcgcaaaccgatcaaaactcggaattgaaacgaccgcgacatcttgattatgctttgctaactgggctttggcctccaatgctaagttaacttcagaaccagtcgcaattagtaaaccatctggtatttctttttgagcagcactgaccacatagccacccttttcaacgccagcaaaggccgtatcaactgatacaggtaaagtcttcaaggcttgtcgactcaataccagaacggttggtttatcagttgttttcagtgcttgctcccacgcagctgaagtctcattaccatcagctggccgaatcacttgtacgttcggcatgcatcgtaaactagctaattgttcaatcggttcgtgggtcggcccatcctcgccgaccgcaattgaatcatgcgttaagacgtagataaccggtgcgtgttgcagtgcggacaaccggactgccgcacgtaagtaatcagtgaagacaaagaatgttcccccgaatacccgagtgccgccatgtaatacaattccgttcatcgcagccgccatgccaaattcacgtacgccgaaccaaatattacgaccatcgtaggattctggctgaaagtctttggcactcgtaatcatggtcttattagaaccggataagtccgcagcgccaccccagataaaggaaatagactttgctaatgcgttaattgcctttgagctggctgcccgactagctagcgcatcatctggctgatagtgtggtaaaacttcatttagctcggctggaatttcacctttaaaagctgctttgaattcgcgtgaccgttctggatattcggcttcataggattcaaacaaccgttgccacttttgctcagcttgtgcacctttttcctgaattgtcgctttaaaccggtctgagacagctgatggcacttcaaaatccgagtaattccagccatatactttttcagctgctttaatgccatccgcaccaattgggttaccatgaacagcattagtcccttgtttaggtgcgccatagccaatcaccgttttcacttcaatcaatgaaggacgatcagttgtcttctttgcgagttcgattgccgcgtcaattgcatcaagatcattcccatcttcaaccactaaatgttgccagccatatgctttaaagcgatcaccaacattttctgtaaaagcctgagatgtcttgccatctaatgaaattccgtttgagtcatacaaagcaatcaacttgcctaacttaagatgcccagctaatgatccagcttcgtgcgaaattccttccattaagtcaccatcaccgacaattgtataagtgtaatgatcaacaattggaaaattaggtcggttatattgggcagctagatgtgcctccgccattgccattccaacggccataccgaagccttgtcccaacggaccagtagttacttcaacgccatcggtatgtccatactctggatgccccggagtccgactgtcccactgccgaaaatgcttgagatcatcaatcgaaacatcatacccggctaaatgtaacaggctatataacatagctgaaccatgccccgcagatagaataaatcgatcacgattgacccaattcatgtgagtcttgggattaatatttaaatgcttcgtccatagtacgtaagccattggtgcagctcccattggtagtcctggatgccccgagttagctttctgaatcgcttcaatactaagtgtacgaatcgtgttaacacctaattcatcaactttatcaaacattccacttacctcctaagccgtcattacaactatttctgtgccgcctgaaatgctttccaatccgaagcaaaactggctaagcccttatcagtcagtggatgagaccataatttaccgaatactgtggccggaattgtggcaatatcagcaccagccaacgctgcttcttgaacatgttgtggccctcgaacactggcagcgataatttccgtcttgaatccataagtatctaaaacttggcgcaaatccttaactagctgaattccattgccaccaatatcatcaagacgtcctaagaatggtgaaatataagtagcaccagcctttgccgctagtaagccttgcgaaactgagaatacaagggtcacattcgtcttaattccttcttcactcagcaccttgactgcttttaagccttcttcagtcatcggaatcttcaccacaatatttgaagcccacttaacttcattgcgagcctgggcaatcatctcttcggccttggttgccgttacctcagcggatactggacctgatacaatctgcgtaatttctttgataacggtttcaaaatcacgaccttcacgtgacaccaacgttggatttgttgttactccatctactaaaccaagttccgcgaaatgtttaatatctttagtattcgcagtatctaagaaaaatttcatgattagatttatctcctttattattagttttcataaattattgaaagtagtactcataattactgattacttagttccatcagtcatccgtttagcacgccgggtaagaaaaacactgcaaagaatcacaataattgtgaacaagataattcctgtaataactgctacacttccgtaactccctaattttcctaacaagattcctggaaccaaatagtcggtatctgcaaacgttgaagctgctaatttcaagtttcccaaaactggtaagataaacaatggcaaccaactgatcaacaaactatttactgtagcaccgatgattgcaccacgccgaccaccagtagaattaccataaattgctgcagcagcaccacagaaaaagtgccccactacacctggaataataacagtagttcctagcgcaatcatgataaacatacttagcgtcccaacaatgaaactgacaaagaatcctaataaaactgcatttggtgcgtatgggaaaataatcggaacgtctaatgcaggcttagaattaggaaccaacttggtcgcaataccttgaaaagctggcacaatttcggccaaaatcatccgaacaccttgtaaaacaaccacgaaaccggcagcaaatgttcctgcttgtactaatgcataaacaatataattagtcccaccactcaatttcgattcaatgtaagctggacctgtcacaatcgccaaaatgatgtaaacaatacccattaaaatcgtaattgaaactgtcgaatcacgcagaaagcccaaactcttagggatttctagatcctctgtagacttttctgcattaccaaaccatttacccatcaatcctgagagcgcatagccaatgttacccgtgtgtcccatagcaacatcatcgccacccgtgattttacgcataaatggttgtgtcaatgctggtgttaccgttaataatgtcccttcaaatagaccaccaagtacaatcgtttgccaacccgcgccaatgttagcgcttaccaatataactgcagttaaacaagaaacatataacattgcttgctctgtcaagaagatatacttaaagcgagtaaaacgagctaataaaatattaacaatcatcccaactaacataattagtgctgttgttgagccgtatttaaccagggcaattgcaacaactgcttcattactaggaacaactccttgcacatgtaacgcaaacttaaacatggaagcaaagggtgacaatgcattttgaagaattccggcaccaccagttaagactaagaaaccggcaaaggtcttaatagttccttgaacaacttccgtacttttctttttttgaagtagtagccctaacatcgcaattagcgctactaaaatagacggttgggtcacaataccaacaaataagttcaaaacagtcttcatgtgattctcctccttttcagcggctaatcatgttcaatattttcttgatccaaaattgtattgacatggttccggacttcttgcttatcaatcaagctttttagtaacacaaccttattctcaggaatacttcctaatgcactttgaagcgttgattcaacaaagaagtaatctgctgaatcagcgccaacgctcccaacatcagaatgatccacttggatatcttctttaacattctcgtcctttaaaatactctgaatgttcatctgaaccataaaactacttcccagaccactttgacatacagctaaaaatttcataatagtaccctcctatttttgtaattcttgctcatgtgcaataacttctaaaatctcagattgactggttgcatttaacatcgccgttactgcagcttcgtcggttaataactccattaactctttgatgacagctaaatggctattattatctacagcagccagcacaaaccataagttaatgggacgttcgtcattaactaaactaatgctgtgattcgtttttaagatagataatccaatcttgtgtacgttaccagccggtcgagaatgtgctagtgcaatctgtggtccaatgttaatgtagggcccttccgactccaccacattgatcatttcagtgatatattcactttcaatcgttttattattaatcaagggttttgcagcaaattcaatcgcttgttgccaattcatatccgtacctgctgatacttgcacagtctgttcgttcaataaatccaataacattcttattcgtcctcctttcttagcatcgctatctatctgacaaagaccagtataaacttgaataaaactgctacaagtgcaacaatgttttttagaatagtgcaactttggtactttagtactacaacactttagtttcccaatacaccgaagacaaggagggcaccgaattgctcttaaattttagtagacgcaagcatggtaatgagctactagaaattctactagttgcatctggttacaccaccgctgacttcttacaacagcatctgcatatctcacggcggagtctgttctatctcattaacaaagtgaacgatgaacttgatcaacatgcagaatttccaattaccaatgtaaaaaaattaggctattaccttccgactgacacagttaagtttttgcaaaaaatgacagaaaaagaaacctctgccaaagtcatgactaataacgcgcagcaacgccagctgctgattgcatttagtatcctcaatgctgccggacgttcattagctgatctgacttaccaatttgacgtttctaaaaacactgttatccgagatattaaagccttacactcacaattagccctatatcatctacaaatcatcaacacagaggccggcaagataatcactggttcgccaatggcaatccgaaaatgggtctacgaccacgcaacacaactgaaaccacttatattgcaaactaatcagaccgtcattaaacccgctaccataaaagaacaaattaagctttttgaaagaataaccggaaaatatttaactgatgacgcaagcattaccattcaactttttttgcattggtacttaactgatattaaagagtccacgaaccagttacgtaattcgatagctacacaaaacgatttgacgttagatcacatctgggctaaaagctttttgaatgattatcatattgatagcgtcagcgaggttgactacttggtcaagttgattaattccagccaattcgctcatgttaattggaacgataccttgattcaaacgttaaaaccatactcagtgcgaatgattgcaagtttcaaccacctctctggtgctcatgtttcgatcaagtcgattagtgacagtctaacggttcacttactttcaacctactatcgtgctcaatacaatatgccatttgaatatcctgatttaaaaagtattcagcagcactatcaccatacttttgaaattactcgtaaagtggtcatcccattcgaacagtatattcaccacgccctctctgacgatgagattgcattaattgccatttactttggtggtgccatacgtgaacaaaagacgagtaccccaacgcaaaatgaggttcttgtcgtttgctctagcggtatcggtacaagccgcctactactccaacaactagagagtcgctaccgtggtattcacttctctagtcctatgaacgttcttcaatacgagaattcagatctaagtaatgttcgcctcgtcatcagtacaattaaattacaaactcagcgcgagattcccataaccacagtatccgcttttccttctgacctagaatggaaaatcatcgataacgctattattaaggccggtctggcaacttctgacacactgaaactattcaatgtggacacattattggatatcgtcagcaactatgccatgataagaaatccaatggggcttaaacttgcgcttaacgactacttgactcaactaacccaggaaccaatactagctgctcctcaagaaaatttatcagagttaataaagctattacccccagaacacgtcggcttcttaacccaccaaaagtcttggcagcaagcggtacgcacgacaatggcccccttgcttgaagactatagtattgaaaagaattatattgatcagattattaatctaaccgagagcaacggaccatacatggttattggatcaggtgtgatgctggctcatgctgccccccgtgatggtgtcaataatttaggcgccaccttctttttacttgataagccgcttcctgtcatgacaaatcaaaagatggtgcgcgtaatcattggcttagcccccatagactacgaaaagcatctttcatttattagtgatttgatgaaacagctacagcaaaaggattggttaactgacctctaccatttgaataatataaaagacttatttgaatacttgtataaggacaactgaatcaatttcaatggccagcagatttttattaatggattcaaaaacgagaccaagattgctagcttggtctcgtttttgaagttaatcctattattttactgtcggataatgcattatttccatcgattcactgaactatttcaacaatatcattcggcgtttcagctcggtatttagcatctttaaagacatcatcaggtagtgctccccatgcagccacagcaaagtcaaccgccgcattctttgccgcttgcatatcaaagatactatcgccaacatatagcgtctgctcgcgtactaagtggaaccgcgctaacgtataggcaattggatcaccactcggctttgggttcctagttaagtccgcagttgtgaccattgacatatttgcgattattggaaaatgaccgatctctttatcaaattggacacgatccttagacgtgaccacaccaactttaatgttcattgccaataaagcatttagcattggttcaatccccttaaaatacgtcaattcattcatactttcatcaaatccaaccatgtatctatctagtacacgtcgccaatttcgaacaccgaattcactcaagatctgctgaccaggacggccgattctttggcggtattcttcaagtggcatatgaacaccttcacggtctgcccctttctttaataaactagcaatcagatccgccgaatttattagggtattatcaatatcaaataagacatttgaatacttcatcaagaattacctccagctcctaaaaaagagccccaagacaattatctcagcgctctaaattaaggaggttataattttaataatctgtcattcaactacaattggtttaatcagctaaatctggatcattaggattagaagcaatcataactttaagttctttaccagccatcattgcatcaaaagcgtcacgccaatgttcaagatcaaagaccttcgtaatcatcgcatcctgattaatagcacccttactttcaagatgtaaggcaattggccaatcataaggattttgtgaacgagaaccccgataggtaatttcatgctgaataattgagcgttcatccaattcattcattggctttgcaaaaagaccaacttgttggaaagttccacctttacgaatcaatggtaaggcagcattaacagctggcgttgcacccgaacagtcatatactttggtaacaccaacaccatctgtcgcatccattacgaccttggccaagtcttctttttgagtatctacaatgatgtcggcacccaattctttagcaatttgtaaacgatcagcatccttagtaatcccagaaacaatgacaaaagcaccaatttctttggcaatttgtaatgagagtaaccccattggtcctggtcccataattaataaagtatcatgtaaagtaaatggcgtcttttgatacatagcgtgaacacatgatgctaaaggttctgacattgcagccattttgtaggaaacattatccggcaaaatgtgagcgctttcttcgcgagtcaaaacatagttgcccattgaaccattggctttagtcccaattccttcacggttaggacataagttatattccttatcttgacaatagacacaagtctcatcagttgcaaatgtcgtttcactagtaacgcgatcaccaggttttaaggtggtaacatcaggacctactttaacaactttacctgagaattcatggcctaaaacaagtggtgttactgcattggcatactggcctttaaatgtatggatatccgtcccacaaattccagtataagcaaccttcaataatactttatccccagttacttcaggaattggaatttgtttcaattccatattgtcatagccagattccgtcttaacaacggcctccatagttttagcaccctttaattcatcggtttcagttgtttttacagtatccataattcattttcctttctacggataatcttttaattaaataacggctgtactaactgtgataatttcaaaattaaccagttcaagacattaccacccgtatccaagttggtaacttctgacgcacccttaggaaaggcaacaatcccgtgcatcattgaagttaacgttggtccaaagtccgttgccatcagcaatgcgaataccattacgatagtagcagaaagtacggagtggacgatatttcctttacgactaggaacaatcaaagcagcaaagaatggaatcgtcgctaaatcaccgaatggcaatacccggttaccaggtaaaataatggctaagaataacgtaattggtaccattagtagtccagttgccaaagtggctggtgacccagttgaaagagcagcatccatccctaagtaaatctttcgattgccatacttctcttgaagtaatttttgcgcaccttcttggattgggattaagccctccattaaaatcttgaccatccgtggcattaagaacataacaccacccattgacataccaagttttagaatgtttggtacactataaccacctaaagcagctaataacatcccaatcacgatccccataaccatgggttcgccaaagacaccaaaacgcttttgaatcgtttgtggatcaacatcccattttttgataccagggattttgctgacaacccacccaatcggaataccaagtaatccataggctgcggcagatccagttggaaaactaataccatctaaaccataaaactcagcaacttttggtgcagtcttatcagcaataattaagacagcaatttcatagataattccacaaagaatagcaaaccaccagttctttgtgaccacgtatgcggttgctgctgccgcaatcatgtgccagtagttccagatatcaatatccagcgtcttagtaaggtttaataaaatcaaacccacgttaacaactagaataattggaatcatgatggctgagataggttgcgcccatgtcccagcagaaacagcgggccaaccagcatcgataattgtcagatggaacccaaaacgcttaaccattgcctgtgcggcaggaccgacactagtcgtcaacaaattaatgactaagttaatcccaatcataccaataccaactgtaatcccagaagttaacgccttacctggttttactctaaagattaatccgacgataaagataataatgggaagcataacactggggccaacattaatgatgctttgtacaacatcagataatactttcatgatgcatcctcctgcttaaaacctagctccttattattgtgcttgaatttcacgtgctttagttaaaatttcatcttgcaacttatccacaccaagccccgttaaaaatcccattgctttaattgctggaatcttgtattcagtaggtaatacagtcgttgaaatcaacatatctgcgtcatcctgtttagatgcggcttcagcaatcttaatttgaatcaagtttgcatcaatattgttctcggcaaacaaatcttcaaccttcttcataacaaccgttgaagtggcaattccggcaccgcaagctactaatacgtttaattttttcatgataatttctcctatttcttctattatttttatttgcttaatagctgatgaacttgattagcgttatcagcgttttccaaagaacttactaatgaatcatcttgaataatagtcattaatgcttgaagcatatctaactgagcatggggcttatttagaccaagaacaaaaactaatttagcatcaaccttttgttctggatcgtccatccgactaaatttgattggctcatcattaacaactacagcaacgaactcttggttgatcgtatccgcatcggtatgtggtatcgccacaccccgatgttctaattgcaaaccagtcggaaaagttccttctcgtttgataatctttggtaagaattgatcagtcacaaacccatcttccttggccttcgcattaattgctgtaaataactccttcgaggttttaaaagaggtgtgtagaaaaatgagctgatctcttaaataatcgcttacttcgacaaggttctcactcaaaataagtcgctcctttcatgttttatataaatgtaatcgctttcaacaattaaaattgtatcattttgcaatacttttgcaatacttttctttaaaaaagtttttaacacccgtttgcaaagagtactttgcaacgacataagcgttcgcaaaagcaagttaattatctcacaaagttagacataacaatctgttaagcgcttacatgtaaaggatttagatagagatttcaatcactttacaaaattagattgcaaacaattgccaaacatgtgctatgattactaccgaaaaataaattttatttttacaaggaggccacctcatatggaagttatgcagcgccaaaagtatattttagatcaattaaaccaacgcggtaccattagaatcgctgaaattagcaaggaaattaatgtttctcgtgagactatccgtaaagatatttacaaccttgataaacaaggactagtgcaggcaattcgcggtggtgctactaccccgcaaagtgtcaacgagacaaagtatggtaagcgtagacacgaagcagttgctgaaaaaaatgaaattgccaccaatgcactacgcttaattcatgatggggagtcaatttttcttgattacggtacaactgcttttcaaatcgccgaagaaattaaacatagccatctaaccaatctaaccgttatcaccaactctactttcgttctcaactcgctacagtttgttaaaaatattcaaattgtactcttgggcggaacaatgcggactagtgaaggttctttgtccgggccaatcacacttgccaatatcaataatatctatgccgacattggtttctttggctgtggcggcgtcaatcttcaagcaggaatcaccaaccactatatagaagaagtggaagtttccaaaaagatgatgtctcattgtcgaatgaaagttatcttagctgatcacactaaattcgaaaaaaatgcactttacaagacagccgacgttaatgatgtggatgttatcatcaccgatgaacaattggacactcagattgccaaacaaattcgcttagccgacatctcattaattagtggcaaataaaaaaagacgattgggggaaaaccatgcccctaaccgtctttcttacttttaaatgccaggttcttaaattattttgccaatttcaccttgactttacgattgaaaccgttatcataataaccgtaatgataaacaaaacaaaagtttgcaaaggagttgcaaaataatgagtgaagcaattaaatccaaaacagttgattactcttctgatgaatatctaaaacgcgttgatgaatattggcgtgctgctaactacatctcagttggtcaactctatctactaaacaacccgttacttcgggaaccactaaaggcgaccgacgtgaaagttcatccaatcggccattggggcacgattgctggtcaaaacttcatttatgcccatttaaaccgggcaatcaataagtatggcttgaacatgttctacattgaaggtcctggtcatggtggccaagtaatggtttctaactcctacttagatggcacctatacggaaacgtatcctaaaattacacaagacaaagctgggatgaagcgcttattcaagcaattttcattcccaggcggggttgcttcccatgccgatcctaagacgcctggttcgattcatgaaggtggcgaacttggctactcaatcttgcatggtgctggtgcggtactagataatccaggtttaattgctgctaccgttgttggtgatggtgagtctgaaactggcccattggcaacttcttggcaagttaacaagttcctcaacccgattacagacgggacagtcttaccaatcttgaacttaaacggcttcaagatttctaacccaacagttctttcacgtgaatcacatgaagaacttgaagactactttaaaggtctaggctgggatccacactttgttgaaggtacagaccctgccaagatgcacaaaatcatggctgaagaattggataaagtcattgaagaaatccacgcaattcgtaagaacgccaaggataacaatgatgaatctcgtcctaagtggccaatgattgttttccgggcacctaagggctggactggtcctaagagttgggacggcgaaccaattgaaggttcattccgggctcaccaaattccaattcctgtcgatcgcaatcacatggaacacgccgacaaattagttgactggctcaaatcatacaaaccagaagaattatttgatgaaaatggtactttaaaaccagaaattgccgcaatcatccctgaaggccaagctcgtatggctgctaaccccgtcactaacggtggtaagttaactaaagacttaattacaccaaatatcgatgattatgctttggacaacaaggatcacggtaaagaagacggttcagatatgactgaacttggtaagtatatccgtgatttgattgagttgaacaaagacaacaagaacttccgtggctgggggcctgacgaaaccttatctaacaaactaggcgctgcttttgaagataccaagcgtcagtggatggaaccaatccacgaacctaatgatgctttattagcacctcaaggccggattattgactccatgttgtcagaacacatggatgaaggaatgttggaagcttacaatttaaccggacgttacggtttctttgcaagttatgaatcattcctgcgtgttgtggattcaatgttaacccagcatttcaagtggttacggaattctcacgaagaaaccccttggcgggctgatgtgccttcactgaatgtgattgcatcatcaacggccttccaacaagatcacaatggttactctcaccaagatccaggtatcatttcacacttggctgaaaagaagaccgaatatgttcgcgcctatcttccaggtgatgccaacaccttgattgcaacctttgataaggctatccaaagcaaacaattgattaatttaatcattgccagcaagcaccctcgtccacaatggttcacaatggacgaagctaagcgcttagttcgtgatggccttggtgttgttgattgggcaagtactgaccatggtgaagaacccgacgttgtcttcgcaactgccggctctgaaccaacgactgaaagcttagctgccgtatcaatcttgcatgcacgcttccctgaaatgaagattcgcttcattaacgttgttgatcttctgaagctgaagaaagacgaccctcgtggtttatcagatgctgaatttgatgctttcttcactaaggacaaaccagttatctttgcttatcatgcatacgacgacttagtaaagaccatcttcttcgatcgccataaccataatttacacgttcatggttaccgcgaagaaggcgacattaccacgccattcgacatgcgtgttcgcaacgaactcgatcgtttccacttagtcaaagctgccttattagcaacgccagcttatgccgaaaagggtgctcatgtcatccaagagatgaacagcattttagacaagcatcatgactatatccgtgctgaaggtaccgatattccagaagttgaaaactggaaatggactgcattgaagtagaacgataaccatgtctaaatcgtattcataagaaatgaaagaagctataccaacagttgtgttggtatagcttctttcatttctgatctatttctatttggcaaaaactatgctattgtagcgttagcataaggaaatcatgataggagccaaatctatgagtatcgtaactactgtcgaagaatcgtatccgacactctcacgacaagaacgcaaagtcgccttaaaggtcattcaagagccgaaagaagtccaaaaaatgacgatttctagtctggctaagaacgttcacgttagtaatgcgaccattacccgctttgttaaaaaaatgggctgtgcaaatttttacgccttcaaacttcaattagctgaaggagcagttactcccgtgacgcctgctggtaaaaaagacaccgttgcggatcaagtctatagctactacaaaaaaattctgagtgggacttgggaacgtctgtctcctgatgatcttcacgctgctgttagtttaatctctaacgctcgccgggtctatctatacgggttgggcagttcgggctataccgcacaggaaatgacgcagcgattgattagaatggggatcgccgccttctcaatgactgacactcatatcatgtacattagtggtggcattatgcaacctggtgatgtcatcttggctatctcacttactggcgctacagcggaagtcaacgattcagttgcattagctaagaaaaaggatgccaaggtcattgcaattacgtctgatgaacgcagtcgcttagcggaactaagtgaccttacgattctcgtaaaaaacagtaaattcgtcaacaactcgcgctttgtgaactcacaatttgccattacctacgctcttgatattatcgccgccatgctattagagaatgcgaagtatcgtgatcgaatgaatcatacaatcgatttaatcacagataataaacttggtaaacgctaaaaaaactactatcaagagttcaaccaatcttgatggtagttttttcgatttatctctgcgcaatttgtgggtatcgctgcaatatgtcaacttcagttcgattaagtgcatggtcagcgcacaggataatcgctgcactatctggattatgatgataaaagtgactatttttgacagtaaacaaaacgctatactgattcgctagccgcatatagcgccccatgatatccatatctaattgaccgttcaacaaaagctgatagtctcttggttgccgcaataccggcactagtactgacgtaaagtcatacctcagagcctgcttaaatgaaatctgaagttcaacccgttcgtaaaaagcccctaaataacggtgttgttcatctggatgtagatccggtacaccaaacattccattttgcaaacgagtacccaatacttcctcattatcttgcattcgtcactcctatttaaagtccacttgcgtcaaatctaacatttcactcaaccaacttagcactaacggaacccagttcgccgcacgtggctcaatatcttctgggtaattatatcgactagtttcaactgtactcaagcacagaccgtgttttccatgtgtaaatgtatgaatatcatactcgacatgatgcctagctagtgcttctgcgtacaataaactattcattgttggcactaccgcatccgcacaagtattccataaaaacgttggcggtgtctgatcagtaactaggttctgactagcccaatattgttcatctggactaattttaaaggcctcttctcgacttttcggaaaacctgccgccaagtcgataaccgggtaacctaagacctgcaagcgtgacgtcaatgggctatcaccaaagccgtgagttttgaggtactcggtgttattccccatcgcgttagttaatgctgcgacgtgactgcccgccgagaagcccatcaaaatcgtcttattcgcatcaccataatgtggtggtccttgagttttagcatactttaaggcagtcaaaccgacatcaattgcgttgggataaactggcccgcgatccaatagactgtattccactaccattgtctgatagccctgtgcactaaaagccaaagcaatcggttctgcttcacgctctgtcatttgaataaatccactgcccggaaaaattagaaggattggccatctccgaggatcataatccattttaagttggtctttccaatagcaggttaatttaaattcaaaatgttgcggcgtcattaatctcaattgctcatatctcattttcacacccccctaaatttcagtactattcttgctagcatataatgtacgtaaccagcccaatgccattggaaaccagttttgaacccgtgggaccacatcttcagggtgatgatagcgagaatcagctaaatcaccaaatgccaatccgtggacaccggctgcatagatatggctctcaaatggaacattatgctcacctagcgctgctaaatagaccagactattcacaactggaacaagctcatcagtccgcgttgcccaaatgaaagtcggcggtgtttgactcgtgactaactcttgcgcatgccagtaagattcatccgtagtcacagccatcatctcatgctgactagttggaaaacccattgtcagatcaatcaccggatagcttaaaatttgcgcaaatggtactagctttgtctcttcaaagccatgattatttaagaattctgattgagcgccaagcgctgtcatcacggctaccaaatgtccccccgccgaaaagccactgacaacaacgtgatcagaatcagcattcaactcctgcgcatgccgtttaacgtagcttaatgccgctaatccaatcgtggcagctgttggataaaacgggccatccgacgtaagattatacttcactacggccgcctggtaaccctttgcaataaatttaagtgctacagcttcaacttcccgctcagagtagcccgcaaagccaccgccaggaaaaatcaacgctaatggccactgtcgatcatcccgaaatagcgtgaattgatcatgttgatagatccacatcgtaaatggctgtccttcgggcgtttttaaagctagtgtgcgtatctccatttccataacctccttaaaatctgtgtcaataacttgccttgaaacagattgagcacaaaatctcgactatcctcatgtgaagacaatcgagatttcagatttacgtctacgtcttgtcctaaaaatcatgggttagactaataaccaagcgatattaatacaagatcgtcggacattttaattcttcttcacgtatgtttcattaattgttgaaacagtcaatccagtcacatcatgattaccacctgggaagagcaggctaacaacgtagctcaaaacaaaagctgaaatgaaggcaacgcaagcaaccaataatgaagagatgtttaatgattgtacccagaaggacaagccgacacttaacactagtccggttaacaccccaaccgtattagcacgcttcgtaaagatcccaacagcgaagattccggcaattggcacaccaaagataccagtgaccgacaagaataagttccaaatctgtgaagcgttacccatcaacagataaatcgcaacggctaatcctaacacgcctgcaatgataatgattccccgagccaaggtaacatcattactatttttgaacttatcgttaaagaaacgttgtttaaagtctgtaattacacacgaggagatcgcgttgagactagaagcaatcgttgattgcgcggccgcaaagattccagcaatcactaatcctgcaaccccagctggcatttgggtaatgacaaaatatggtaccaccgcactcgtattgaatcctgctggcaaggcagctgtgtgttgatagaaactgtaaagaatcgtacccattccaaaaaataatggaatggtaatcaatgctaaccagccattagtgtacatagatttattagtatctttaatcgtagctgtcgtctgataacgttgtacaacatcttgactaccagtatattgatacaaactattaaagatttgaccagctaagatcaacggcacaaacttagatagatcgccaatattaaagtcgttaccagagataaacttatgattggtaacgacatcgttaaccaccgtaccgaaaccacccttgatataaaagattcctaaaacacaaattaacagagcactacctagaagcaagaatccttgaataacatcgctccaaataactccttcaatcccccctaagaatgtatagagaatgcaaaggccaccgacaacacaggcaattagaattggattgatgtttgaaaccgatgtaatagcaataatcggtaaatagatgacaatggccacccggctgatatgataaagtacgaacagcaaactactaatggcccgcatgactgggctaaaccgttcttccaagtattcataagctgtcgttactttcaatttgcggaaaaatggaatgtagaatttaactaaaattggaataataattagaatcgaaaaacttccgatagcgtatgcccagtcactcaaaaatgcttgttctggagttgacataaaggtaattgcgcttaaagtagttgcgtaaatactgaaccccgccgcccaagcaggaatatgcccttctgctttgaaaaatgaatccgtgtttttactagcttttctggtaaaataagctccgacacctagcattgccaataagtatgctcctaagacaacccaattcagaactccaaatccaactttactcatgatttcgcctcgcttgttttatttaaactaatatgtgatacagctcgtttaccatgttgaataaatgttttaagcattgatggcgcaataagtgtcgccataacagtcaccacaatcattgccgtatagtgattatgatcgattaagcccgccgagacagcgacattcgcgacaaccagtgccatctcacctcttgaaaccattccggcgcccacaatattggcctcattccaggtcaatccaaacaatttaccaccaatggcaccaccaatttgcttgcctaaaatcgcaagcactagtaacaatccgataaagactagatcgttttgcattcccttaaaggtaatttcaagaccaatgctgacaaagaatgctggaataaagacggcatacccaattggttcaaccttagcaacaagttgcgccttaaagcgtgtttctgaaatcgctaaccctgcaatatacgcacccaagacatcgctcattcctaacttaacggctaagaacgaaaaaccaaaacagagcaccatcgccgctgtcgtaatattctcagatgcattaaccttattgaatcccctcaggaagagtgggacaaaccacttagcaagtgcgactgcaacgacgaagaacagtactttcggcacaaccattgccacaagcgattggttgtgcgcactagcagtaccaaacaggcttgtgctgattcccaataacaccacacagataatgtcgtccgctacggccgcgcctagaataatcgcaccttcgcgtgtatttaaataatccatttctttcaatacttgaacggtaatgcttacagaagttgcactcaaaataagcccaagaaaaattgaagtggtcagcgagaaatcgaacattcccatacaaagtagtacggccgatgccgttggaaaaatgactcccaatgtcgcaacagttaaagctggcttccagtaacgaaaaagcaatttcaaatcgccctctagaccagcgataaacattaaaataatgactccaatttcggcaaagtactgaatgaaagtgctatacgttaagatatgaaatactgcgggtcccgctaaaattccgactaatagttccccaatcacacttggcaagttaaaggtagccgcaatatgcgcacctaactttgtcagtaataagattaaaactaattgcaaaagatagttcatattattgaacctcactaacttaacgcttgcttaaccaaatcaatctgtcccgataaatctgcagctgcaatattatattcgaggaatactgggatttcgggcggcaactgacctagtagacttttccaatccgtagccccttgccccaacatcaccgttgttcgatccttaatatccttcaaatgaaagacggtgattgctgacttcaatgctgcaaaggccggttcaggttgttgatcaatccaataccagttgccggaatcgaaagtgtaccctaatgacaacttttgtgacttaacccaagcaacatctgactcaaatgtcgccaaatcaccattcgcattaggttggttctcgatcgtaacttgtatggaggtagttgctaacagctgagttagcgcttctaagtcatgtgcttgcaatgttggttgcacaccaaagctatacttcaatgatttgatatgatacttagttgccagttctagatttgtcactagacttgcgttatagccatcactgctaaacagttcctctggaaccgaataatagagatcccaatgttgtttctcacaaagctgactgattgctaacagttccgccgatcgcgtctcgggtttgaagaattcaccgcgaacttcaactgcactaacatcagaacgagttactaatgtttttaggcactccagttgagtggctcctgcctgaacttgtgactcataaattgcggtgttaattccgatcttcatgatttagtccacccttcactgatttcaaaataaaaaaccgctacttaaaatcttgcaaacgtgcttagaaaactgggcgttaacactcagtaagcactgcttgcactattttttagtagcggttgaactgttcgaatgattattacgttatcaatttatcacataatccgataattgtaaacgctttctttttaaataaaaataattatcgtgttaataaccctgccatcgctccgtataactgggctttatcggctaattcagccgtggtaatttttgttttaattaagtctggcggtaataacggcttcaacgcattattcagtaaatcaaccaaatattgcccctgtaatgatactgcaccaccgatcaagagaatgtcgggatcaaacaataataggattgatgctaatcccgtcgcaacttctgctgcccaatcattaatgatggcgacatacgggaccgtaccacgcttagcttcttcaaacgcatccttaacactcatctgatattttgctaattgatgctcaagcgttaatgttgatgctcgctgttcataatttgtcttggtaagggggtcatacaatgtataaccaatcgaattggctgtcgcatgggcacccgtcataagccgaccatcttcgacatacgcacccccaatccccgtacccagtgccacgcaatatgcagaagttgcgcccttggcaccacctgctaattgttcgcctagcaaagccgcatcaacatcgttaacaacaaatactggtagactagtttgcgccattaaagcggctttaattggtgttccctgataatctgagatcgttggccctgcgtattgaatcgcaccatctgcgcccacaattcccgctgtactaacgccaatcccagctaacgaatactctgcttggtagtccctggttacacgctgtagttgctttaagatcaggccatcatgattatgctcagtcaggcacttaccctcatgacttagatgtaatgcttcgtcaatgagaccgtacttaatggtcgttcccccgatatcaaatactaaatattgtgttgtcataattatcatccttgccttattatttggtcgaatcgttaagatgaacggcctaacaataccacaataattatttttttatcaactaaaaaagaaatttaatatcagtaaaataacgatcgtgtaagcgttttcggtacataatgataataattaccaaaatatcctattgtaataatttttattagaagctatagtatttcctgtaagcggttgaattttgagatgattattacaaatccatcaaaaaataaattttaaggagttttatacttatgagtaaaaaactattgtatgcagcacaaatgacggccttcgacaaagacggtaacattaatttagatggcatccgtgctctcgttcgctacaacattgacgtcaataaagttgacggcttatatgtttgcggtagtactggtgaagccttcatgctgaataccgatgaaaagaaacaagtcatgaagaccgtctatgacgaagcaaacggtgcgattgacttggttgcccaagttggctcactaaatctaaaagaagcaaaggaactcgctaagtttgcgactgatcttggctatccgaaattatcagccgtaacaccgttctattacaactttacttttgaacaaatcaaagactactacaacgaaatccttaaagatgttgataacaaattattaatctattccatccctgctttaactggggttgccttaacaaccgatcaatttgcagaactctttgaaaatccaaagatcatcggaatcaagtacaccaacgcggacttttacttacttgaacgggtacgtaatgcctttccagataaactcatcttatctggatttgacgaaatgctcttacctgcccttgcactgaatgtcgacggttgcattggctcaacatataacttaaatacaccacgtgttcgtgaagaaatggacgcctttgacgctggcgatattgacaaagcacgtcaactacaaaacatcagtaacgatatgattactgatttaattgctaacgatatctacccaacgcttaaattagtcatgaaacatatgggggttgacgccggctacgtcaagaaaccaatgagccatccaacccctgaaatggaagctggagctaaggcaatttacgaaaaatacttcaagaactaatctaatttatacaagtagaaagcggtcttttttatgaaaaatacattcttaaatacagttaagggctcattaatcatctcgtgtcaggcattacctaatgaaccactgcatagttcatttattatgtcacgaatggcccttgccgctaaggaagctggggccgcgggtattcgtgctaattccgttgttgatatccaggccattcaagacgaagtggatctaccactcattggtctaagcaaagtcgactatcccgactcaccggtttatatcacgccaacgatcaaagagatgcgggccgttgctgctacgggttgtgccgtagttgcctgcgatgtcacgggtcagccgcgtccaaacggtgaaaagctggcagagattgtagccgccatgcgagcagaattccccgacaccctcttgatggccgatactgataccatcgagaacgtcaaagcggcggataagttaggctttgatattatcgggaccacgatgcacggctacacgccggccacgactggtgccaacattgctgacaatgacttcgcctacttaaaggaagtcctccaagccacatcacgtcctgttatcgctgaaggtaaggtagacacacctgaaaagatgaaacgttgccttgacttaggctgtcacgcggtcgttgtcgggggcgccatcacccggccactcgaaatcgcacaacgcttcattagcgccttataatcgtatatattaacaacaaagccagtcgtacggttgcttaaaccgccgactggctttattgttcgctgcactatcattgttagcaatccaaagtgctaaccttatttttagtattgcatgtttaaccgcttttgtcttagcacggggttagcgactttagggttaatggcaaccagtttgacggctctcggggcaacgactaatggtaccgtgacttttcaagatgatactagtgccacggccccagtcgatcccactagtcccaacgtcccgttgacaaccaccgatccgaataatccggcaactaacaataccggaacattgaccctcgatgtggcccccaaaactatcgactttggtaccgtcaccacgtccaacgcagccaaaacttacactgcaattggcaactacaatcaatatctacaagtatcggacaaacgcaccactgccaacggctggcaagtcaacgttaagcaagaccggacgttaactaacgctagtaataatcacatgctgactggtgcggtgattcacctacccaaaggaactgcgcgtaattcgctaaacgagcccgcctcagtagccgattccaatttagttgttgctcccagtgtaagcgtaaccaccgccgaccaagtcgttttcagtgcccccaaccgagcgggtgttggtaaagcgacttccacaaacacttggaacgcgggtgccgtgaccctttcaatccctaagctgacagcccaagtcggtaactacacgaacaacttggtttggacgctagtcgccgcaaccactaactaggaggtaatcatgaaaaaattgatgtgcttattcggcgtaattggtggcttggttttcatgagttggacctcaccaagcatccaggccaccgctaccaatgccgaagttcaatatagtgttaacaaaatcagtcccggtcaagaagtcgatgctagcagtccgtttttcgaccttaaggccaaggcgggcaccacgcgcaaaattcaggcgcgagtctataacccgactgaccaatcaatcacggtcaagacgcggctactcacgacatttacaaatgattcaggccaaatcgcttacacccaaacagccaagcgatacgatgccagcttaaaatatcgttttgatcaaattgcgactttggcagccggttccgataaagtcacggtcccggccaaaagtaaccggggcgtcagcgccacaatcaacattcccaaaggattcgataccggtgtaatcttaggctcatggtacttcgaaaaaatggggcaaggcgcgaaaaaagcatccaagggcgtcaatattaaccaaaaatatagttatgcgttagcggttaaactgacggccaaagaaattgcacagcctaagttgactttggggacggtcactcccggattacgcaactatcgcaaagtcgtgctcgcgaccattcagaacccagaaccagcagtggtctcgcaattaaaattgacgactaaggtcaagaaaaaaggcagttccaaggtactctatcagaacagtagcgacaacttgatcatggcccctaattcgaacttcacttaccccacttttttagacgatcaagtcatgcgggcgggcgattacaccttatcggtcaccgcaacgactaacgacgctaagtgggccaagaaaacttggcattggtcccgggactttaagattacgactgaacaagcacgtcaaaataatcaaaaagctaaaaatgacccggccgcccccatcagtatctggtggtacgtcctaatcgtcatcgtgattgcgggcctgtctgccgggatcgtttatctgattatgcaacgacacaatcacagatcctaaataagcagttaattttagattatcttctagcttggcacgcaaacaaggaggttatcactatggctaaattcaggcggctagttttactatcattgagccttggactagccctcgctggtggctgtcggagtcccgacgccctagcggctaccccaactgacactagtgtgacattgaccgactggcaaaccgggacggatctgacaaatttccaacacccccgtccccaccaatatctagcggtacccaacatcatcgccactgctaatcaacaggcttcgactcagacaccatcatccgcggcaatacgtccagatcaatcagtgctaccacaaacgaatgaagcccgccaactgttagtctggttaggtctgttgaaagctggcttgactggttggctcgtgtggctcatgcaacgccgaagggagtgagcaatttgcaacgaccacgaagattaataacggcttggctcgggttactcgttctcttaatgagtctactcgttgtcaacggcggtgccatttatgcgacagcgaccaccacggccacaccaatcaaattcaaggaaccacccacggaattagtgattgggcaaccttttacacttcagttggccgtacaaggttcccaggaacaccaagtcatggttgctattcctgaggccctcaccgttgaccaaactaaaacccggcaagccaacagagcgagcctcgctgagctggattttgatgctgacaaccggaaactaacgttgacaccatctgatccgacagccagtaccacgttcgatttggtattgagtgccagtgaagcgaaaacctacaaagtgaccgcggaagcactgattactgggccagcattagcgaccactaccgcttcagctgtcgccagtagtgaaaaccgacgacccacaccatgaccgctgaaccaataactttcaccgtggccgcgggctccgcagtcgactcacctcctgaagaagccggcactgaatcagcacgtgaggtcagcaatgatgccgaaagcacctcttcggccagtcaagacccgaccactgacgattcgtcagcaacagcaacacaagcggctgccacgaaacgcgatgacaacaatgccacaagcaaatcgtccgaacagtcgtctagtaccaccgcgacatcggattcgactgctgacaacgacactgctactagtcgcacagcgcaagctgattcggaagtagaacggacaccgaaagcgactaaagcgactgccaccaaagccgctaatgatatcacgaccgccgcaatcgtggtcaatccagatggtagcacgaccgtctcaacttacgatgatttaaaatcagcgtataccaataccgccgtcacgacgattaaattgggggccaacattacccacacgtcaacaagtgctacagaattaggcactcgtaccaccagcctgacaatcgacgggcaaaatcacagccttgatctcggcatcggcaacttcacattgggttccacaaccaccgcccagacaatgacagtaaaaaacttcagtagtattcgtggcgcaattgcgagtggaacgagtagtggtggcgccgccggaatcattcaaagcgggactgatagtggaactaatgctggtggtgctcgctggacgattacagtgagcgatttaatcaccaccagcgacgtttaccgcctcgtcaacgctcctggtaatcaagtcaatgtcagtggcgcagtcaccgcaacaaccgtcgctgaaaacatgattactggtggaatgacctttgccgccagcagtacctacatcggtcgcaaggcgaatagcagtgccgccaacaaagctttcttcaacttcacggcaactagtacagtcgggactggagaccgcaaagtcaccattggtagcgctgctaatgttaacttgctaggcagcgcatcagacgcgactcggggtattttctatgaccagtatgatgccgtcacggtggggaccaacgcgatcctgaccgccaagatgtacggtaacgtctatcgggcagaaacagcaaacacgtttaccgccaacgcaggcagtaaggtcacgtttgagaacttagccacaactagtagcaatgcactctactacgtcaccccgttgattccgctaagcaacaacagtacgtttactgtgacaggtggcgagttgtatatcactagcagtggttcagcccccatttttggtggctacatgtccggtctgagcgtcttgctagattcccccaaggcctacgacattaaaaatacggactttgcaattctcgttcaaacgggttcaatcgtcgagacgaccattaaaagtttcaaaatcacgaacagtaacctgagtatctggtcattgtccctactgaacctgctgagcgccagtgtaacctatcaagggatcactgccatcgaacagaatggggtcctgattaccaacagtggtagcgtcttaccgggactactcaccttctcggcggcacgacgaattgcgaacaccctctcgttgccgactgtgcaattcagctcaccgtatacgagtgacttgaacgcccagctcgtcaccaatgccgacaagaaggtccgcgttcgcgttatcaccggttatacggaatcgaatggcacacaaacgccgatttacgccggaacgggaacggcaaccgtcaagttgacagatgatcagggtgcaacgcaaagtggtacgactgacagcagcggttacgtcaatttcaccttaaattattttccaacggccggcgcgacgatgacagctcaagcaacgaccacctatacttcagatcccgtcaccataaccgtccaggataaaacgccgccaacaccggtaaccgttaaagatggaaaaatcgttgccaatcaaaaaacgattgctagcggctccacgacgacggctggtaacacacttcgttacacggttaacgggaccgccgcagctgataacaacggcaatgccatcaccgcaaccgctgccagtgatgggagttggtcccttgcgatgccagccactaaattaaaagctaacgacgtcattcagatttttgtgaaagatagtgcggggaacgaaaatccggtcaccagtacaacttatcatgatgccacgtttgccgccgctacccaatacaccgtcgcaccggcaattggcccgacagcaccaactgagcccgagcaccctggtacgaccaataccagtgggagcgaaaacactgggaccggtaatacgggcgaacttcgtttagactacgcgcccagccaatttaactttggcagtgtcacaacaagtatgcagcctaaaacttacgccgcccagacaatcaacggtgtcgcgaaacagtggctccaagtttcggataatcggttagcaactcacggttggaccgtcactgcccgtcagaacagtccttttactagtactagtggcgcccaactcaccggcgcgaagttacacattcctgccgggcagacctataatgaacgcgctacgggccaactcaaaagctacgcggtcaatctcacaaccgccgaacaacccgtctttgcagccccagcaacggccaacgtggggaaagacctttcaaccaacgtctggcaacccacccaagttcaattgaccgttcctggcaacaccgcccaagcgggccaaacctataacacaaccgtaacttggacgctaacggctaacgtgacgaactaacgattaaatgtgccaaactgaggctcctcggccgtacaccttaagtactggccccaactctagcaattggaagcgcgacttcaaagcaccattagaccaccacaataattgtcgatttcatcacttaaatttgaccgtcgctggattgcccatcattattgatgacgcgacggttttttcctgtgagtttctaattagctaatcatcagcagccactagtttttcatgtcatataccgagcttaagcaacacatcaacttaaaattgccaagtccgtataatgggcttggcaataatcaacctagttagtggctaaagtttgtaacgcctgtaaactagccgtactgagtacatccaccggctggcttaatcccggttgaaagaaaaagtcaccataggctaattgctcgagcgttgctcccatctggattgcgagcgaaacggtattgatgaccgccgttaattctgctgtagacattatttgtgcacctagtatccgatgagttttatcataaaacaacttaaaatgaacggtcgcattcaatcgagctggtgcggatgccaccaatcggggaaccgcgatgtaagttgctaacactggttgttgcatacggacagctagttgcgtgtttaggcccgtagcagcaaagtaatatcccgccgcattaagcgcggacgttgcctgaacgccgggaaacacaattcgctgatccgttaacaagttatgcgctaataaccgaccggcatgactggccgcgctgcctaaagtgatccgctctttagtacccgtgggcgtaaaccgaactttagtcgcatcgccaatcgcgtaaatatctggaacacttgtttgaaaataatcatccgtctcaattaatccctcagaatctagcgtcaaagttccccgtagccatgcagtattcggccgattgccgactgcgacaaggactaagtcggcagcatactgaccacgattcgtttgtaccgctgtcacgtgtgttgaacctaatatggccgtcacccgctcttccatctttaattgcagcccattctcaacactcgctgcagctaaaatttgcgtaaattctgaatcaagatggtgactgaatggccgagcgttcacatcaataacagttacttgcttgccggtttgtttaaataaggctgcaaaattcatcccaatatagccgcctccaatcacgaccacgtttttaattgctgctgacttagcggccaattttaactcattgatgctggcacggttttgaatcgatcgaacaccagataattcggctccgggaatcggtaactggattggtaactggattggtaacgatccaacgctcaataccaatcgatcgtaatgatcagtctgtaattgcccccgttgattacgagcagtaatcgtgtgggtcgctggggtaatttttgtgaccgtcgtttggtcgaatagcgtcacctgctgggacaaggccaaccgctctttttcagcatccgccggagcccaatccaaagccgtcgcgaattgcccgtgctcgtaccaatgaatctcattatccgtattagctgctaataagccattgaccgtttcgcggccgccatgtgcagccccgacaataataatttttgccatattttccgcctctgattacttaaattattgttaacaacgctatttaagatacacgttgtctttaactacaacaatcgtttggctacggaaatcactattattaaggcacaaaaagcagtaaactgtttctaaaaccaattaggagatctttttgtgacccaactcaatcaacgtcgacgtggcaaccgactggaaaacgcgatttatgacaccacctataccctgcttagtcaatacggcctcgaccaggtcactttttcacgagtagccactgcggccgctaccagccgcagtgttctttatcgctactgggattcgacctttgacctcatctttcatactattattcatcaaatacaaaagactcccattgcacttacgaccacgccattagatactggcagtctccgtaccgatctcatttcgttagcgcaacgctttatccaacaaactagtacggggcccttccgctattttcggctattgtttgccacagccttgaacgcgcagaaccagcgcgatctcacgcagttagtgactcaaattgatcatgccaacttgaccctgatcgagccacttctgacgaatgcacaaaaccacggtgaacttcagatttggcctaaccaagccgcacaattagtattgtttcaacaattacggtactgcgacatcatcaaccaaccgatgaacactgatcagcaactcaccaatctcattgatcaagtcgttttgccggcattgcgagcaagtggcgttgctaaccggcattttcatcattaaagaacctcttcctcacaagtcaaataaagtctgatttcctagcccatactgcgttggaaatcagactttatttttaatattgaaccagcgtcacccttaactagccaaaaccaggcgacgcccccctttacccgtctaacaaattgtaatctggcgcttattgacaataatctgcccttcagccgccaattgtttaaactgacgactcagggtttcgggagtaatccccaaaatattcgccaattccttcttcttcaacggcaattcaaattcgatttgtccggattcaacggcacaatcgcgcaaatacgccatcaaacgcgctttagcatccagcaaatctcgtcgcaattgattcttctcagcttcaatcaattggtccccaaaattattgatcattgctaatgataaactggctgattcacctaataatcgctgaaaatcatcatattgaatggaacagacccacgcatcactcgtggcttgaataaatccctgattctcatgcggtgcaaatagccagtgttgtccgacgacatcaccactacgcaacaactcaataattttctccttaccattagcagctaaggcataaattttagccgttccctcatctaaaatgagcatgccttcctgatggtcgagtggctgacgaatcaactgccctttttgataaaatttccggtgatgggtcaccgtgattaatttggctttcaccgctggcgttagcggtgaaaataatggtgaacgactcacacaatccatttttgaatgcataatttctccttttcttgatctatgtcaatttttatatgattagagtagcatatactgaccatataatgaagaactggaggaattattcatgactaaaaaatacgttgctaacatcgtcccgctgaacgccgaaggaatcggtactgccccccacggcacagcgactttcactgaaactggtaaccaattacacgtcaccattgaaatgttcgataccccggccaacacgcaacactgggaacatttccacggctttccagatggcaaagcagcacagattgctactatggcccaagatgtcaatcacgacggctttgtagacttgcctgaaactgaacccgtttctgggacgacgatgatcccatttgacaatgcgccccatcacatggacgtaccgaatgataattacccagttgccgacgcgcagggccacttcgcttatgaaatcgacgtgcccttaggcgacctacaagctaagttcaaagaagtcttcggtaccgatgacttagaactagacaagcgggtcatttatattcacggcgtcccacaagacttagccctacctgcatcagtcgctggtgaagtgggcatgtatgatgctcacgtcaccctaccaattgcagttggtaagattgaggttacggaagactaggcaattattacttaaactcacaaccaaaaactaagaccgcttcccactatcagttagtagtgggaagcggccttgattttttatgaaatcagcaaaaacaaatccattagaggtaattgtcctttgacatcttattttaactgagagccccgttatcaggaccaaccatcagtagcacgtcgcaattaacatcaataatagtcgtcagctagataccaattgagttacaagatcgatttgattgcgtcagccagtggtaccagcggatgacccagcaccctttcaaaatctgttttggtcaccacatcctcaccattattgccatttttaacatactcctgcattgcaagttcaaagttagtttcgctaaatgcagctaagtctgcttgataagtctcaggatcgactgccgtaattttcaagtttttaccggtcgcaacttcaagagcgtgtgctaaaaacgctgttgaagttgatcaaaaaagcccgttaacacgacaacaggcactcgcaatcgattatcatcaatatggtgtgatggggctattcaaagattggctcttcgatcgtttggaaatggatattcaacaacttgccgacttccaatatcaacgcgtacccgacttcttgaaaagagcgatgcgtcagtatcatccaaacttttgaattcatgtaaatttaagaccaaatcggactgggcatcgagaacacatggtgtccagtccgatttggtgccacagcttcttaattaatgcttttctgtaatacgatttaaaattcagatttttctaataatacgccaataattttttcttaattgattacgaaactgaagatgatgcttatcgtaatcctggttacctaggtactgaacacaagttagtagttctttagtttcttatcattcacgtaccaaagttgataacaacattcgtattgaatttgacgtaattagtcctagtcttggctcagcacttgacttataatccggcacgggttaaaccatcattaattaggtatcgtattcttatagaacaccgggttagatcaacctggtgtttttaatagatactgtaattcataattactaacagtatcagttgactctatatactttctaccgataatgtgataagttaaaatatataaacttaattaatcagcattcaattaacggaggaatcatgttacaaattggcattatcattccggcgcttaatccagatgacaagctcattgctttaattcgggattttattaacgcgcccactttgatgacaaaaattaaagaaatcattatcgtcgacgatggtagcgatgaggctcatcagtcaatctttacgcaaatagcaacactaccactggcgaatttaatcattctccaccattcaaccaatcatggaaaaggtgccgctttaaagactggttttagttatcttcaaaagcacttttccaacgattcctggtgttgctaccatggactcggacggtcaacacactgtcgccgcactcagtagttgtttggataaatttattgataatccacaacaactcgtcattggtgtccgtcactttacgaatggtattccatttcggagtcagtttggcaacgtcatgactagcggcctcgtccgattattaacccatcaagatatctctgacacgcaaacgggtttacgagtcattccatgagataccttgcgattcttgttcattttcctggggaccgttttgagttcgaatttgatatgcttcttcaagctaaaaaataccacattcaagttgtcgagcaaccgattccaacaatttacctcaatggtaactcgtcttctcactttcgagtcatccaggactcaattgctatctatgctcgtttttttaaatttgcaaccagtgggttgatttcttttgtgattgatatcagcctgttttacattgtcctgttcttacttggtaatcatattttagatagcattctggtggcaacgataatctcacgggtattgtcttccatcgttaattatgcaatcaatcaccagattgttttcaatcatgcaggccaccagacatttttaaagtatgcttgcttattcatcgtccaaatgttggcatccggttttttcaccgatgctttaacgatgatcttgccagcatccaacggacaattcatgccaactgttgccaaaatgattgttgactttatcttattcattattagttatcagattcaacgggattttattttcaaagaaaggccgcaacatgtcaaataaacgtcgttttctctacttttcagcaattgtattatcaattatttatctgctgtggcgcatcttttttacgattccatggcacgctaatattttcacgctcatctttgcgctcttgctggtcattagtgaaattctctcaaacctgactggcttcatcttaattttcttccgaatgttatccactcagaaaaaatggaacttaatcattccggattatactgccactcaaccattacccgacgttgatttaattattgtgacgcacaacgaagacgttgatttgttgcgcaagaccattaatgccgcgacttatattgactatcctgataaaaacaaagtccacattgtcgttgcggacgatggcaaccgccccgaagtgatggccctcgcaaaacactaccacgtcgggtattctggaatggagaataataagcaagccaagtctggtaatatcaaccatacgctagcgaaaatgcattcaccactgtttgctatctttgacacggacatgattccattttctggttttttacgtaatactgtgccgttattcacagaaaattttcaacaattagcagatgacccagaccacactgatcctctgggattcgttcaaacaccgcaaagcttctataatgcggatatctttcaatttaatttattctctgaaaagattattcccaatgagcaagatttcttttcacgcgatgtcaatattttaaacggtggtaataaacgggcacttttcacaggttcaaatgctgtctttttgcgtgaagccgtagataaagttgggggcttcccaactgatacaatcaccgaagatttcgaattgggaacaatgcttaatatggccggctacattagtctcgctaccaaagtcccacagtctagtggtattacaccaatcgacatgaaaggcgttatcaaacaacgcactcgttgggcgcgcggcgttattcagagttgccgtaatttgcatatttttaccaatccgcatctatcatttattaaccgaatcattctactcaacacctacttttattggtgggcttttttccgtcgaatgatttatatgattgcgccaatcttatacgccctgttcaagattcaggtggtcaacgcgaatttctggattttgatggttatctgggcacccggctacttcttattacattatgtcatgggcgacacttctgggatgggtgacacagctaagattcgtaacgagcgctggggtgaagtccaagaaacttttttcgccccctacttattcatccctgttatcctcgaaagtcttggcattaaggccaaaaagttcaaggtcacggccaagaacgtgacctactcacttaaagacaaactctatattttgccatacttaacattatgggccatcaccttagtggctattattaagtttaactatggtaagtatggttccgagattctggttggtagcgtgattacgttctggctgttaatgcactttattaatttgagcatgtgtctctttatttccatgggtcgccccgtttatcgcaaaaatgagcgctttatccgccaagttgttggttccgcacaatcaagtgatggtcagtggcattcaatcctaacagaagatgtctctgaaggtggtatcgcgtttaaaattactgacggaccagtcaaggatattgctgaaggcgacacaattaaacttactgttaaacatcagctgtttgatatccaactgaatggtaaagtggcccggatcagtcatcgtgataacactgcaatttatagtgttcaagttactgttgcacctaacaaaaaccgtgatcattatttgcaattgatttatgacggcgccaataagaccctcccgagtgttcaagatacttgggtaacaccgttcgacgaactatatatgaacctagttgttcgggcacgcacctatgaacgtaaacttagtcggcggtttaatcgcttttaggaggaatcaatcagaatgtctgtttggattggatttatcttatacgctatcggtctattaggctataatggcacactgcgtcgcctaggcgtcagtccctatctagcatggattaccgcgatgctagttcaaatcttaatgttatatggttttgcgatgacgggttggttaacaatcggtattcaaattgtgacttacttcggcatcggtctcgcattactttggcttggcttgagtttctttcacaaggcccgactcagatttgaagggattcacctctttgatttctggatggtggggctcggtattgcaactggtcaaacattatggcatagtcccctcgttcattatgacaacttttcacactgggccgtcatggttaaattcatggtctttactggacgcctgcctggcgctagtgaccacctcatttcatttacatcctatccaccggccacagccttattcattacccagtttgcgcactgggttggtttcagtgacggtgctatgttagtagcacaatttattttgatttggggagctgcatatgctatttttgctggtctaagggatcgttcacgtgccctaacgagctttgcattatgttttacactggcgatttcgtttgtctttaacgttgcaattcgtcttaacaatctgctggtcgactatgtgcttccaatcttgacaatcgcggcgctagttggaatttttatctaccgtaaacaccccctattattaagtgctcacgttataatttttattagcgcactgttactcgtcaaaaattcagcaacattttttgttatcataattggcacttatttcttatacactttgattaccaatcatcattggcaatggcgtcgactacttactattcctattcaatttggcattacgctaggattgggaaccttgccgtttgtttggtgggaatggcacgttaaacacacttttaccgtttccaaacaccaaattagcacccaagcttacgccagacaattgagtggtgaaaatcatcaaaccttaatcaaaattagtcacaaatttttaacacaaattttcagtttgaattctctttcaactaagggcatcctgttgatcaatattgtcctgattttgacttggctattcattcgtatccgtcagcatcagcgaaacaacttgctaggcattgcactacttttagatatgatcttcgtcgcctattacggcagcttatttggcatgtacatcttatccatgccatacgctgaggccattttactcgacggttttgaacgttatatggctagcattgttattttaaacttattcatcggggccatcgctttagtccgagtactcgattatcagcaatttgagcaaaactttcaaaagcgtaatactcaggcatttaaaagcgcaacgactaaaagtatttaccaaatggcaactcttgtgactggattctttgccatcactatgatgtactcagaaataacggggactaaatttacgaatgaaatgaatcataatactttacccttacaaatggtccgcgtttctagacagtggcaccatttaaatcaccagaaagtcctcatcgttgaccctgaagttgtcgatgttaatgactattatgctggctatgtggggcgttactggtatttcactgataaagctatcggtcaagaaaactttatgatgacacctaaagccttcaggaaaactgtcgaacagtaccaatacgttgccattccggagactcatcggacgttcactgttctcactgaaagagtctttcatcaacacgtggtaactggcttatttaaagtcactaaaaatcgactgattcggatgcattaacaattatgaaagcaggttttattttggcagtcattggctttatcttctttggattggcattgattggttatagtagcacactgcgcttatgccacgttaacccttacttaacttggatcacgggcctcttaattcaaatcgtgttgctctatgtctttgccatgctcaactgtttacgcccaggtatttggattgtgactagtttaggtgttgtcttactagtgacccgccttggacttggttacttaggcaaaatcagtatccattacgacggtttacatctctttgatatttggatggtcttcttaggtattgtcatggcaatcgtcctattcaaaagccccctgattcattacgataatttttcacattgggcgacgatagtaaaatttttgacgtacaccggccacctgcccaacgccactgataccattatttcgtttacttcctacccaccggcaactgcgctgttaattacccaatttgtgacctttactggctttagctcaggaaccatgcttgtaggccaatttatcttaatctgggcagccagttatgcgatttttgcaattctgcgcgatcgaacacgtgggttaaattcaatgctattatgtctaaccattgccatctcatacgtttttaacattaacattcgactcaataacttactcgttgattacgtgttggccattctgacagtggctggtcttgtaggaatttttatttatcggcaacgacctaaaatgctggctgcacacgtagccttattctgtggtacattactactcgttaaaaattccgctaccttttttgtcgctattctgctcatcgattacttaatcacattgattcaccagcgaaaaaatggtcactggtttcagcaaactctcaagatcacaagtcaatttttaggcacactcatgattgcagtcttgccttttatttggtgggagattcacattcacctaacctttacaacttcaaaacatgaaatcagtgcaactgcttatcaaagtcagctggcaaatgacggcttaaatggctttttaaaaatcggccataccttcttaaatcaaatctttaattggagttctctctcaactcaaggattactcgtgcttaatatcggattaattggcgcatgggccattattaaatacggttgtcatcatcctaacccgttacttaaaagattaggtgtgcttgacctgctaacagggctgtattacatcagcctgctgggcatgtatgtgttatcgatgccttatgccgaagcgattacgttggatggcttcgaacgctatatgtcgaccgttattgttttaaacttatttatcggcatgatgattctagttcgtgtcatcgacgagacgttctatgaacaaaatttgatcaaacgaagtccccgtactttccgttcaatttggaccaagaatggctatcaactggcaaccttcctaatcatgttctttgctattattatgatgtattccgaaatcaacgggaccacgttcacaaaccactacaatcgccattcgcttcccgtcacgcttagtcatattgctaaaccatggactaagctgaataatactaagattctgattgttgattcccaacaagttgaagtgaccacttattatgcgggttatttggctaactactttttctttaccaataatgcaagcggtcaagcccactttagtcgatcaccacacaactttcggaagtccttaaataagtacgactacgtggttatccccaagtacgatcgttctttcacacggagcgtccaaaaagcttaccaccaacacattcgaactggtttctttcgtataaagtcggctcatttaatccgcattcatcgctatcaaagcttgcccaatcaatagataacccgctaatcaaataaattagcacgattagtccctgtcaacaaccaagactagtcgtgctaatttttacattcagatgtcaggatttgattcctatatccagtgtgccattgaacggcagtgcgtcaacattagtcagcttttaatattgcccgctgcacgtccaacgtttctaacaaactgaccgcacagtcagcacccttattgccactcttaaagccagcgcgatccatagcttgttcaatggtatccgtggttaaaacgccgaacattatgggcgtatcggttgccaaactgacggtcgcaatccccgtcgtcacgccacgacaaacatagtcaaagtgcgcggttgcaccccgaatgactgccccaagtgcaatcacgccatcatagcgcttggttgtaatcattttttgaaccgtcagtggaatctcaaaagctcccggtacccaggccacgtcaatattggtttcattgaccccatgctgtaccaaactttcttgtgccccagttaaaagttgctgcgttacaaacgcattgaaacgcgccacgacaatcccaatcttaagcccgttgccattaattttgccgttaaaagttgtcattcgtgtccctccgttagtgtgagttgatgatgaaatcgatcacgttttgtttttaagtaagcttgatcgtactgattggctggtatttctaaggggacccgttcaacaacatcaatccccgctgcacgtaactgctcaaccttatcaggattattagtcagcaaacgaacccgtgtaatccccatttggcgtagcattaatgccgcaatatcataccggcgctcatccggttgaaagcccaactgcacgttcgcatcatacgtatcaaccccgtgttcttggagtgcgtaagccgctagtttgttagccaagccaatgccgcgaccctcttgccgtaaatagacaaaaacaccgcgctgagcttgactgatcttttggagtgcgccgtgtaattgatcaccgcagtcacaccgctgcgatcctaaaacatcacccgtaaaacattcagagtgtaaccgcactaacactggttcatcgtcactgatatcaccagcttgcagtgctactggcaacgccgtatgaccggggacttcgaaaccagtcatcgtgaactgaccatccttagtcggtaagttgacgctcggggtcgttgttagctgggcggcacccgtttgaatcacgtaggtggtaatatcttcgatggtaattagcggtaattgtaagccctctgccaaagctttgagatcacggcgccgcgccattaagccatttttcttgataacttcacaaatataggccgcgggggtcacacctgctaattgtgctaacgtgacggctgcttcagtatgaccacgccgcgctaacaatccaccagtccgcgcaatcaatggaaaaacgtgcccgggatgatagaaatcagcggcctgactattgggattggctaacgcttgaatcgtggtcgcccgatcagctgccgagattcccgtggacgtcgtctggtgatccgttgagactgtaaatgccgtcccaaacgcatcgtgttcactagtcatcggtgtcaaatgtagtcgcgtggcgatacttggcgccatcggaacacagagtagtccccgtgctgatgtaatcatccgattcactgtcgcagtggttgctttagcggctaggccaaccatgtctccttccgcttcgcgcgtctcatcatccgcaacaataatcaattcgccccgttttaatgcggccaaggccgctgctacctttttcattgtatccatcttaatgactcccctctaaagctaattgccgggccaagtacttgcccagaatatccgtttctacattcaccagcgttccaacttgtaactcagacaaggtcgtcaccgcttgtgaatgcggaattaaatcgacttcaaacgtcgtctccgtgaccgctacgaccgtcaaactaaccccatcaactgccaccgaacctttagtgactactagtgcgcgatattctgacggtaaactgatcaacagacgcagcgcgtgcgcatcagattgtcgctgtagcacttgcccacagtaatcgatgtgaccctgaacaatgtgcccatctatgtgcgcgttcacttgtaacgcacgttctaggttcaccaatgaaccgaccacaaggatctttaagttcgttcgacgcatcgtttcaggcatcaccactacactgaaagcatccgcttgtcgggtcgttaccgttaaacaaatgccgttcaccgctatactgtcaccaatcttaagattcggggtcatcagcgacggtgcggtaatcgtaagggtcatttccaacccttgttggtgtacttggctgacgcggcccttggtttaaataattccagaaaacatttacttaacttcctttcgaacggcccgtagccggatattcgtccccaaacaagttaccgttggttgttcaaatgtcaacggcgtcatcacagcggccccggtgacggctggcaaacccgtcccaccaatcatcattggtgcgatgtagctgacccattcgtcaatcaattcagccgcaacaaattcagcttgcagatgagccccaccttcaactaagagtgactgccagccttgttcgacacatagttgactgattgcagcgggtgtccagttaccaatcaggacgtgtacattgggactgtttcgaagttggtcgtcactagccgcagcctgacgacaaagtaaccaggttggggcctgaccgtcctgaacaagccggtggtttaacgccacggtactcgtattcaacaccaccaatcgaaccggtggctgcaccattgccgtcagtcggacggttaattgcggatcatcaatcgttagcgtccgttcaccaatcagaatcgcttgaaactgtgaccgtaagcactgactatcgatataactagcatgattggaaaccagcgtccgagtcggcgtttcagtattaattttgccatcaagcgttatcgccattttcagggtgatccatggccgctgctgcacataaaaatgattgtagtgggggttcaacgcgcgaactttgtccgttaaacagcccgtcaccacatcaactccgtggttcaaaagatactgacgtcccttaccacccacgattggatggggatctaattgaccaatcacgacttgccgaattccagccgcgacgattcgcgcactacacggcggcgtcttcccatagtgtgaacaaggttctagtgtgacaaataacgtggccccacgcgcctgttctggtgtggcctgccgcaacacatccacctcagcatggtcaccgccaaaataatgatgataaccttgagctaacacgtggccgtctttgactaataccgcaccgacctggggattttggtacgtcgccacccccgccaatttggcttgatcgatagccatttgcataaaatcagttaacattggttcacctccaacaaaataaaaaaacacccaattatcaaatcatcgataatcgggtgtgaagtgttcgccaaatagatttcaccagtaggatccagctaaataaacccacttaaggtcgccaatagccactactgcctagtaaaattcaagcaataattttcttctcccatccagactatactgtcggtcccagacttgcactgggtccaccgctcacgcgggtcacggacttcaacttacgttgttaccgtcggtcgggaattgcaccctgccccgaagaaatcgtattcagttttcaccttttataaaaacactttcttaatcaattgtcaatcaccccttttagtttaaccacgtgaactgctgtgttaaactgctagcaaactttataaaaatgataatgactaacactaattcttaactttttccagaaaattgttcgcttttcttaactagtttcaagtttcagtacggtacaatgaaatcattcataatatcggagttgaataaaatgtggcctaattatcaaacaaggcgctggcaagtggcagtgacagctggattactgtcccttgctatcatggggattgtcttcgcaatttgggggatcacgcccttcggtaaccataacttattaattagtgatatgggtggccaatacttatcatttttcaccgcgtatcggcatgccattttaacgcatagttttcaattatattcattttcacagtcattaggcggtaacgcactacccacgattgcttactatctattaagcccatttaacattttgatgttgttgtttccggcggccaatttgccaaccggacttagtctactcatcatgttaaaaatcagcttgattgcggtcactatgacggcttttttacaaacgcattttcacacaaagcggtggtcgactgccatttttggtgttgctttcagcctctctggcttcgttgccctcaactattttacgatcatgtggttggatgcattaatttggttaccactggtcattcaaggactcgaccacttaattgcaactggtcatcccgggcgctttttcggctggttatgggtcagtatcgtcaccaattactacttaggctatatgacttgcctatttgtgatttactattttatttatcaactatttgaacacaaacgccctcaggacagtctttggcaaactgttcgtcatcaattttcgttaattcggcacgtcgtggtcaccatgctactcagtgggttaagcacgatgtttgtcctgatccccactggtttaggcatgctgaccacggctaaatctgcggtcaaattatcgagctacttaccggtcccacaattcggtttagctgttttgagtcaatttggcttaggtgccgccaattttacgactcggctcgtacacgcaccaaccgtcttcagcagtagtctggtcgtcttgctggccctaagtttctgggtgcagcccaacttgactaacgctcacaaatggcatggcttcagactattacttgcactcttcttgagtatggacattcggaccttagatacgatttggcacatgtttcaaacgcccgctggttttccataccgcaatgcttttttctttagctttgtcttgatcatgatcgcttttgaagcctggttagcaggcccccggcggatcgccttgcgctggcaatggttgttaccgacactcatgctcagtgcgctgatattaggctggttcgcccaacgaactgctaagcaccccttaacaacttcaacgctggcgctcagcttagtcgctgtcatcttaaccgcaattgccttattcgcaacggcgaagcgatggcaaacgctcagcttggcaggtatcgtcgccttagaattagggactaacagtaccctcatgatggcgaagtcaccactagggaatcaggctaaatttgtaactgcctatcgaaccgaataccgccaaatgcaagctgtcaacgatcctgatggtcaattatatcgcgttgaaaatcaaaatacgctaatcaatcaggcctacaattatgatagcaagtatcgtaattacaacgacccgatgttatttaactttcacgatattacctactacagttcaacttttgcgaaccaaacacgtctcatgttgaagtcacttgggctattttctaaaaacgcccggcgtgtcagttcagaaggcctaaatccggtcactgatttactcttagatgtaaaatacgctgtgcaattaaatgccgtgggtcaagcgacgacgcggctccgtagtcaaaacgggttagggtttgccgtgccaacagcatttagacagttaaagcttcgtcagaatagtgccattatcaatcaagaacgcctcttacaaagtttgcggccatcgaaacgcgcctattttggcaacgccacgacgctctcagatcacgtcgtccaagattcacaggccaaacactatccgtatttggatacgattaaattaaggatgacccgcaccgggacgctgtattataacgacacgactcgtcaaacaaagtacaccacgatgcgggtcaacggccacttagtcccgactaagttcaatgccaacggtgagttagtgctccgatcactaggttattttggcaaaggcgctattgtcacgttaacggtcaaacgcacccaaccaacgcttggcacccatgtccacatcgccagcctggatcaagcccggttcaaccaagtcaaacagcaactgctatccacgcgctttacaccgacttaccacgtctcgggcattcataccgtggtcagtggtcaagttaccaatcgctccaagcaaaaatggctctacgttgctattccagccgacaaggggtggcgcgccacggtcaacggcgtcaaagttactcctaaaacggtcattggtgggatgttagccctaccgattcagcccggtaagaatcagattcagctaacttaccacgtcccgggattgctgggcggactactgatttcaatcataagtggacttagcttcattctttggcgtcaacgatatcgccagcattagaatcgtgtcaatcaaaacaatcggactgccaagctattctactaggcagtccgattgttgttttaatggtcgctgtaactgctaaaccagtcgcgttaatatcggttttagataggacacattatgttagtcaaaattaattcaggtttcatccaaagaaagaccctatgctcagtaaaatctaagttgattgccggtttagtaacgaatgccagtgcgttatacactaaacgcgtgtacacctgatttttagccttgtcaaaggtggcatcttctcaaataacgtgctcaatttgaactttcaagttagtctcttcccaacactcgcgtttggccgctacttaacggcgattatctttcgtttaaccacaaataaaagtcccaacactggcaacaccagttattaagactttcgattcaagttttattattcagtttctggccgtaaccgacctaacgccaaaatggtcgccagcgccacacagccgacaactgctagactggcggcacccgttgttaacgcgtgcggcttaataaactgctgttttatcacgacttgtaagtacgcgtgccgcttagccgtcacccggcctgttaacgggctgtagttggccgccatcacaccataccggacgggcgtctgaccaatgtttttaatcgctaatcgcaggttgcccgccgctgtcaacggataattcaaagtggtcagctcattggccgagccccgccaccgtttgacaacatgcgcccccttagtcaaggtaattgttacgcgcccatgcgtcgcaactggcttcaaccgtaaaacattacttttaccactaacggctaacggcgttgtaacagcgtgacccggtccaattttttgaaccgtggacacaacataacgcccatttccctgattgccacgtaccacatcagtaatccgcgtcgcctgactcgtctgccacaaactaaccacactgattgccgccaatacgacgaccaaccacgtcagttggcgccgcattactcggttaaggtgccacaccggcaactcacgaccacccacaatactgaggagcatcaatcccggtaatagcggcaacgcatagcgcccttctacttcccaaagtccgacatgaaaagccgttaaaccgagaattgccagggcgacgaacgtcacggcccactcgcgccgcttcatcaaagtcacgattgcttgcaccagcatcgtcaggtaaatcgtttgcgtcattagaaccagccaaaattgaagctggcgttgatgattcaaataccagcggggcgcacgaatccactgggtggtcaacttaaagctatcaaaatcgccagtcgcccagaagacccgcatctttttgagtaaatgtacgagggtccccgtaacgcccatctgatgtaaccgctgctgaattatttgctgggtctgttggcgcttggccgccgcagttggcatctgattaacgcgcgcaaaatcgtcatgtcggtactcacccgagctttgggggttcaagctcatcgcaatccagctggttgccggtaaggcggcatcagcttggcgcgtataacccgcttgctgttgggcagttcgcatcaccgcaaacatcaccccgagtgtcatcactaaactaacgagccagcctaacatttgccgaccactgaattgtcgttgccaccacaagatgatccccatcaatacgagagtgagccagagcacaatgagattagtcttcatcaccacgcccacggccaccaataacccatcaccaatcaaaacgccccaacgacgccagccggttaagcttagtccgagtgtgagcaaggccaagctgtctggaagtagtggcaaaacgagggcgtccgtatatgcaaatagtccaaatgcggccacgggaacactgacgagccacaacaaactaaatgagaccgcccccggttgccagtaacgccaacggtttagtaaatatagcccactgattagtccggtatcgatccagataaagcggatgacatttaataatacccagggcgtctgcgtcagtttcattaatggcttgaacagattcgcaactaataacgtaaaattcacattattgggataaatcataaaataatgttgccaatgatggctgccccgcgctaataacagtgcctgctgccgaacgaaaaacgggtcggcccgcgccacgtccacaaaactagtggcaatcaacatttggacgatggcgattaagccgaccagcccaatcaacagccaacgatactgacgagatgataactgtttgagcacctgccggccagccatcgtcatgaccaataatcccagaaccatggctaattgaacgaccggtgacgcccagtccgggttgccgaagaagtgaatcggttgcaaccacgccatgccgactgcgacgaccaataccgcggccgccagccaattgacgctcttaactacgcccttcatccgtgcacccgttgcgaatttacaatagctggctgttgagttgccgtataatcatccgtttcaataatatagcggggccggtgcttgacttccgcaaaaatttttccgacatactcgccaacaatactaataccaatcaattgcatcccacctaaaaaccatagacttgtcatgagtgaggaccagccactcgttgcggtccctagtaatccttgtatcaacgcatatagcatcatcatcaaactaccgccactaatcaccatgccgaacaataaaattactttaatcggtgcgattgaaaatgacgtgatcccatcaaaagcaaaagccaccatcttacgtaatggatactttgaaacacccgcaaaacgtggttggcgatgataataaagtttagttgttggaaatcctagtcgtggtacgattccacgcaagaataaattggtttcctcataggctaacagtgcctgaactgctcgttgacttagcaatcggaaatcggcgtgattaggtactaattgcacaccaatacacgtcattagccgataaaagccgtccgctgtccatcgtttgaaaagtgaatcactacttcgttcattgcggacacctaatacaatatcactaccagcacgatagcgtgccaccatttctgggatcacctgtgggtcatcttgcaaatcagcatcaatcgtaatgactatttcagcagtcggactggcgacctgcatcccagccatcaacgcgttttgatgaccaaaattacgactaaacttaagacccgtcacggttgcgtactgtttttccaacgacttaatcagtttccaagtcttatcttgactaccatcgtcaacaaataataacttacttgccgcattgacctgtttgtgttggatcagatccgtcaaaataccatccaagatgtgtgcagacttaggtaacaccgcttcttcattgtagcaaggcacaataatggttaaccgtggattttgcatgccaattcccccaatatgactcaaatagttttacgaaataacaattataattgcaactttcggtatcattagcgccatgcgattgtggcccaaattagacacttaacgaaaaacattccggtatcattaataacgcagaatatctgccccccacaactatccacgactaattttataatcattaatgcctgacacccacaatcctcaaaggcaagcttacgactattactgtaattatttatctcaatcatccaaccattgacctaggcaactgtcagtggtcacacagctcaatagttcaaattgatagtaccaatatcttcctcgcaattcaaacaaagcaacgatttcggtaccaaccattaacaaattatccgaacttaacccccgtgctagtaccacccattattacgaaccggtacaaggaaaatgcggaaataaccttgtgttacgaaccattcagaattccaaccgaatcttcaaaaccggtttatttaagattaagtgacggacttattattaaccacaacaatccatttaagctcacaaaaatgggccttcataatttctgaaagcccattatataactctaaatccattgcattctaatttcagtcaaacaataacttatttagctggtaaccatacaatcatcaacaacaataaggcaagtccaagtattgcaatgagcaagctctggtgattctcgctcgtttgtggtagcgttgctgccttcgaaacttgaccggattgatctgcagccaccgctagtgagccatttccagttgaacctacgctagcttgaccattaggtacggttacgtttgagtcagtagtgccgttattgagccccgttatttgactagtattcgtacttgattgttctggtatggtcgtaccagattctgctggttttgtcgaactaggctgtttcggctctgacgtgctaggttccgccggtttggtggtaccaggctgtttcggctttgtcggactaggctgggctgatcctgtgtcaccaggttgttccggctttatcggactcggcttaactggctttgttgcaccaggctgttctggctttatcggttgcaccagttgatcggtagcctttactgtcactgccgccgtctgaccttcaacaatggtaaagtctaacggtgtctgattcaaagcataacctgctggcgctttagtctcaataaattgataacgaccaggaactagttcatctacccgaatttgcccccgtgtatcagtctttaagccatgccgaatggtttgtccggcgccatcttttagattataaattgcgccagctaaggtttgaccgctgttagcagccaccttcgttaaaacaactgaaccggtaaccaccgctgtttcatcaaattgcgtcacttcaaccggcgttgcgaccgtatcggcatcaatcttaaaattaataggtgctgaattcagcgtatagcccacgggtgctttagtctccacgaattgatactgcccaggaattaaatcagtgatatttatgtcaccattctcattagtagtcagcccagattcaatgacctccccggtactatcccgtaactggtattcggcgccacgtaaaaccgccttagtcgttgaatcacgtttggtcaacgtcacactgccgagctgattatcgccatgcccggtcccattgccaccataactgacattgccactgacggtggttccgttcatggatgccgagttagtccaatcattacttccttcattaactttcgtcagtttactattataaaccatattaactgcagttgtgacgttgctgaaagtaaaggttagttgattaccattaacgacaacttgtggaacgattgtacctgattgtacgaagttcccagcattattatacgatccagtctgagcaactaccgaacccggcaaataactttggttggggcccaatgtatcattgacgacaaccgttccaatattttgaccagttggattgaaggcaatgttccacgttaaggttgccggcaatccatgatcatcgtaactcccaatccaaccaattttattgagtttccaatcaaaatgaacgtcagaatcggcggttcccttaacataaaattgtagtgttccagcacggtttgtccccgtttgtgccaatgtatcattaaaagtaatctctccagacgtttcacctgccttaatcgtaaaaataccaacaacccggccattatcattcttcaatgggaaactcaaatcaacaggcgccactgtaccggcgggcaaatcaacggtcgccgtatcacctgctgcaattggctgaccgtcacgtacggaccaatcatacttaacagtataatcactccatttactcaaggtacttgtctctgtgaccaccttaccatcacgatccgtaattacatccgctcccccagtcaggccagtcgctggaatcaccgccgctttcacggtccgccctaacactaagactgttgctaaaactgttaacagacctagcaggactgaaaacaatttaactcgcataaaattgcctccattcttttttaaacacaaccaaacattgacaactagaacgttaattgaaatcttcaatcgttctattaacaagttatattaagcccatcttttttatcgccgttattaataagttgccattgataaatttacaaacaaatagatataagtccaatctgcattaggtatacggagaacttcgccagataacgtcaactaactgtattcgaccatatttccgcttaatattgagacgtctatactagccacttatcaagtgttatcagcattcccatcacaacgcaatctagtagttaaaaataaattgacgttgacccccaaaatctctaaaattaagccattagtctttttactaaattaactttaaggagtatcttcatggcacaaatttatcttgctagtccgtttttcagtcctgaacaagtgacacgggtcacacagcttgaggaagccctcactaaaaatcaaacggtcacggatttttattcaccacgtctacaccaggacgctcaagccgaacagttcaccaaaacttgggcgaccgaaattttccaccgtgacatggcccaaatcgcagccgcgcaagtcatcgtgactgtcttagactttgaagccaaaaacttagattctggtaccgcctacgagctaggtgtggctaccatgcgcgacttgcccatcatcgccttgcaggaaaaagatgaggccgtcaacctgatgattaccgaaagcttacactggtataccaaacaagtgagtgattttgaaacttacgacttccaacaattgccccaaggcgactttgtcggtgaaattttataataaaaaacgaagccaggctttcgactattatcgaaagtctggcttcatattttgtcgttcttaactttacttaccagtgggccccaatcgtctgttgccaggcaaagtacggggtgccctttgtcaatgcttcaaattgatcatccgtcaagttgtgccagtcgatgtcacgggttgccaattgtaacgaatcggttaaatgaagatggaagtcggtgatccaagccaacagcggtttcaacactgacagatcagtatttaacatctgataagtagcggtatcactggtcaacgtcaccgccaatgtgtaacgagccttcattcgtacgccattaccaagttgccgcacgattgagcgatacaatcccagttcgacgtccgtaatgactgtaggtattggcgccaaagtttgaaagactgtgccgcgctcatcggccaaactcagccgactaggcgtaatcgtcaaacgtccatgagcagccgcgccctcattcaacgctttcaagataaacggcgtctttttgcgcgcggtcgaatacttgtgatcatttaaaacaatcgtcatataagctggttgatgcgtaatattgtccgcaatgttcgtcaccgcgactggcattggtttttgcatgtgataatctcccttgtcgatctgcttctctctacggtcgattatacactaacacggctcaaccaacgtagcgacttactaattgccttaggccgtcaccggatcaacatgctcagcaacggcatgagcagccgcgattcgaccgaacgtaaagatatcactaagcgagttaccacctagccggttacccgcgtgaattccgccggctacttctcccgctgcgtatagcccgtcgataatctgaccgtccgtatttaaaacgtgagcatccggatcaatcttcaagccacccatcgtgtggtgggttgctggtttacgcggcgttgcgtagaatggtgccacggcaactttcaaatcaaaggccgtcttatgaaattcaggatcctcgccggcatcaacgtaacgattgtaatccgcaatcgtcttggtcagggctgccgggtccatgccaatttggtgcgctaaatctgtcaaagtatcagcacggaacaaggtcccattcgccacctgctggtcaattttagcttgtgtcgtgttgtaagccgtctttttaatttcatcatcggcaattagatagaagagactcccattatcaatggccgcctgagttaactcatcacgactgccgtactcattgacgaaccgttttccttgctggtttaccatcacaaagttagccgggggcacttggagcccactgaataattcgccggtctccggatcagataccggcatcatttgtgagaagcccatcccaactaatgctgcaccaacactagttcctagccgaattccatcaccagtcattgcgggtgaattagtcgtcttgacatcatcgtcgatggccgtccagtacgtattgtacttttgtaacattttagtattcgctgcgaaaccaccagaagctaaaatcaccgcatcagcatggacaataactttctcatgagccgcattagtcgcaatgacgccacgaacttgcccatctgtcaccagtaattcttttaccggcgtttccgtcataatcgtaccaccctgttgttcaacaaaggcccgtaaagtcttgatgtaagcaaaacctagatcccccattggcttatgcccgcgccgccagatggctccaactggcattgtcacttggctttcatcaaatttcacaccaatcgattgtaaccacttgactgaatccagggcgttatccgtcaattcttttaccaaatcatactgaccgtgaatctcttgaccgttcaaatcagtccgttgaccacctaaataagtttgaatccgatgtaacaaggttgaatcaaataaggtgcccttttgattggtattggcagtcaggtatgcgtcaatctgctgtttcaatttacggaaatcagcccgatattcaggtgcaattgtactttcatcacgctcactcagatccttcaacgtttgcttttcacctggcaaagctgcaaactgtcgttgccaatccggatcagccgcattcatgggtcccccagcgcgaacggtattaccaccgacagctgggaatttttctaggacaacggcttgatgaccagcctgtaacactttggccgctgccgtcaaaccagccccaccagcaccaaccactacgacatcagtcgtcacttctttgacagcaggttgagcgacctgcttagtcgcacgccgtttcttcaaatcatcaggattggcaccagcttctttgaccgcacgaacgactccatcgataacaccatgactggtaattgaagccccggaaatcgcatcaacagcgagcgtttgacccgcaataatctccttgggaatgcgttcaaaagccacatcggcaatcccctgcgtttcactactggtatcaatttcaatattttcaatccggtcagcggagagggtcactcgcattggcaattcgccattatgtccagtggccgtcacctgataagtacccgggacaaagctaagcgcttctggtgcccgcatctcggcgacgatggtcgcaaacttctgaaactttgcaaaacaactgtccagaaaatcaaccgtcccttgcacctttaaattaccttgatcgtcaaaagccgtttgggcacggcctaataagaattctgaaccgggcatgacactggcgttaacaccgggagcgtctaaaatctggcgcaggtgtagttgcgcgcgtgacgatccttggacactgtatgaagccccaacaatcattactgcttgaccatctaatgggtgaattttgaatgataaccattcaataatgcttttcaacgcggaaggtacggaatgattgtgttccggtgaggcaatgataaccccgtcagccgccgcaattttagtggcaaagttttgaatgatggtactgtcagtttgatcattcgattcatcaaacatcgggacatcagtcaattctaaaatttcgatttcggcttgtgtcgcaaaatgtcgttgcataaattccagcaatatccgattgtacgaatgctgagcattcgttccaacaattccaacaaatttcatgtttattcctccccagtcacttgccgccacgagaactgcttactcttttcgaaaaactgactcgacggcatgattttattcgttaaatctacaaaatcaatgaattcgccaaacgcattgtctaattcctgaactttatccggataagtcaggtcgccctgatcatcaaaagcttgtagtgaacggcctagtaagtattcaatatttggcatcaccagtgcttttaattccggcgcttctaaaatctgtcgtaagtgcgcttgagcgcgtgaggttcctagtgagccgttcgaggccccaacaatcataactggtttattaattaacggccgcgtggtatatgacagccattcgattgcactttttagtacggccggaattgaatgatcatactccggcgtggcaaagatcacgccatctgctgcggtgatcttatcactgagctgttgaattgctactggtgctgttcggtcttccggttcattaaaagccggtaaatcttttatttcacaaatttcaatcgtggcttgttgctgaaaatgccgttgcatatattgcagtaactgccggttggtcgatttggttgcattcgtcccaacaatcccaacaaatttcataatttcagatcctttcaggatgatttaaacagtcgttttcgacgagtagctactgaatgattggccactcttaatactgattagtgtaagtgaaagcgctccacttgtgaaatatttatttatctatactccgataacaaatttactatgtcgacgattcgcgttaaaattaatcatgttaaaatggttggtcatagtgctatctgccactatcgccaggatgttgacagaacttattgaacacgttttgaacgtccttatggcgatgcaactaactcaacatgaccaaatcagcaatcaaacgaatactcacctaatcacaatgcgagaggaaggcgctttatgccaaaatcagattccagcgaaatgcgacggtttttagatgtgttgctcaagcacggcaattttacccgggcggctaaagatctctacatttcacaaccttacctcacccaaagcatccgcaatgttgaaaaagaattgggcgtcaccatcatcaatcgtgaagtcacgccactgcgactgaccacggctggacggacttattatcaatatttgacggcgctcgaaaacgagaaagatcactttaataagcaaattaggcaatacacgcatgccaaccagcaagtaattcggctgggcgtcttatctagcctcggctattacttattgcccctatttttacctgcttttttgaaagcccacccggccactaagatcgaattaaccgaagatatcgctagtcgcaacgaacagcgcgtgctccacggtgagctggacttcttaattggtcaaaatccggaaaccatcgcgccggggcttgaaagttatgaccgcggtcgggacgggtactacgcgattatcccgaacaccgtcaactggtaccaaccccatcaggccttcattaatccgggagcgctaccccttaacgacctgctacaagcgcctctagtcttgtctccccacgggtcatcgattcgacgccaagttgactacttattacaaaagcacaacgtgacaccgaatatcgtaattgagagcacgaataccgccaccatcaccaaattagccactgctggactgggtattacctttttaccagacagtgtgcatacccaacctgatccagaacgctataacatcttacctttgccccaagcgttaatgtccctgaattatttcattgcctttccagccgagcattcactgaaccaggtggaaaaagacttggtgacgatcttcttaacccagttagaagccgatctggcacaatcgtcaacaatttcatgatacaacaaatacccatctacttagccgttaagacggccaatgtagatgggtattttaacattaaccattatttcaaagacgcaccagttaagatatgcttttcgttgcgaaattttgacgccacgcctacactttagctaaccaatacatgctaatctagtcacgaaaagtaaggatggcttatcatgataacgaataaatgccgttacggactggtaggtctaatttcgatagtcctaacgtttggtctttccgcttctaatcggctccgtgcgtccttcaacgctatgccggctatcacctacatgtcaaaatatggcattatcaaccatcgcacgcaatggcaagccatgctgcatgcgactgatcatggtcgcaaaatcacgtcactgacccaactcaatcaaattctgcgcgctgcaaatttacattcattcgccgtcgccaatctccgccaagtcgaacatgccacccgtccgaccaagacaatgagtgccggcctcaccatcatcaatgtgccagcattttacagcagtcagcaccaattacaaaaacagtattggacacaactccagcacctgattaaacaaactaagccgacagccgatttaatcttaaacttcgcagcaaatactggtggtagttcggcaccgatgattgctggcctggccgccatcattccagacggcaccctctacaccggcatcacgaaccatcatcgcaaccggccacgtatgatgtaccatggccgaatcactggtggactcggtcaagatgactttaacttttcgcaaccaacagcggcccactttcgtcatatttatgccattattggtaaccagacagcgagtgccgcggaggtgaccatcatggcgctaaaacgtaacccgcacgttactttagttgggcgttcttccgctggatatactagtctcaatggtggcgtctttttaaatactgccgtggccgtcatgacgattggaacgctcaaagcgaccgtcaaaatccatggtcagcaatacttcaataaccagccgttaaagccagacataccaacgttatatcagccagtggcaccattacaattaggacaaccgccccacttagatgccgattttctgtccgagttacgaaccatcatgaagcactaccactgacgccccgtcctttcagcttcaactgctggattcacaaacttcagcctagtcaatcggcactattgtgattcagttagccgttcagctgcactaaaaaatcagcttacgcagccaccgccatccccaaattacaattgtaatcagaatagccgtgaccaaccaagcaactaacacgataccaatactgacggtggctgccagtgcacggttcgccatcttcacagttgccataccaggtacactctcaggccgtagcacaccgtaagcgactaagcgcattgcaatcaaaacggtactataactcgcaccaagttgccaagctggccgagccgagccatcttctttactctcgtcttcatcttcttcatagtcgtccgccggatcaaaccgtcgggcccactgttcagttgtcaacggatctgctaaatcccagtgttgccaggcatccgcccagttggctgtcgtctcatcattgagcgtgtcatcgagcgtgcgttgcatcaatttattctgcaaagttgccttggcagtcaaatcaccgtcccactcaagctgatcaaagaactcaatagctaacgacaagccctgcatgagcgtaattgcggccggatcaatctgacttttcgccacaagctgtgaccattgcgcgtccaaatctcgatcagcacttttttgccattgttcaagttggctaaccaattcaaaaatctcaaaagagtcctcagtatcctggtacttatcgaaaaaggcccacatcacggctggtaattgttcagcagtcaacgtcagcggggcggcagactccggatgcatgctctgacgatgtgcacgccacacttgccaaccggcaccactgacctgagtggccgcccgtttaccaatttcttgcagatattcctgatcttgtgcctgcaaaaacgcgttcatcgctgcataggcttgaacttcttctaattgacgttctggtcgtaccccagctggtagcactaattcgtcatctccgtcggtctcatcaacttcatgttcagcatgatcattgggcgtaagcacggccctaactgcccgcgtccatgcttgccacattggatcatccgccgttacctcataaattgccccggcttgcatccgatttagtagtgacttgacggcgtcatcgatttcatcgtcgtcaaattcatcctcaagtcccagatagctagtttccaaccaacaatccgcgagccaataaaatgtcgttacatatgcttcgtgttcgttcatcccgataatctcccctaatgcgtgcaattttaaatcatttgtctctgtgacggtcccgtcacgtgccacagttgccggattatcgtttaatcaatcagtctggccgctagattacgcgcatcgtgcacgccaataccgctcaacgtgccctaattcgacacgtatgcaatggtcaacgataacaactaatcactcgtagtaacttatcatgtcaggatattaattgcaattaaaatttttattttatctttaatgacggcccacgataattaatggtgcaacgtctcacccaccccaatggaatccgtcatcaaaaataaaggtcacaaaaaaactgttaaaatcattgatttcaacagttttttcaaacaccgtgtcgatttagacaaccgtgatccccatcaacggttgcccgtcagcgatgacgattaagttagttttgttcgtctggtaattcacccttcgtttgatcaccagttggccggtaaaagttacgaccgtccatggcaaagatccgctccgtatacgtgcccggttctgcgtgtccaagtgaagtctgcatcatttgaatcgacgcgtccaactcgtctaagtcatgtaagatttcagcttccataatatgaggccgaacgggtgacccatattctaacaaaccatggtgcgcaagaatcgtatgccgcaagactaaaacagattccgactgctcgtcaattttcaactgttgacaagtctccacgatttgttcatcgatcaggacaatgtgaccgaccaagtttcctgccaacgtataagtcgtcgagaccggccccgacatttcaatcgtcttacccatgtcgtgcaaaatcgcaccggcgtatagtaaggcccggttaacgtggggatactgatcggcaactgccttagctaagcgcaaaattgataacgtgtgataggccaagccaccggcgaacgcgtgatgatttttcttcgccgcgggatagctaaagaatcggtcatgaaatgtcgttaacatgtgacgaacaatccgattccaattaggttcagtaatttcaaagacaaactgattgatttcgtccgccatcgtgtcggtctttagtggtgcgtgttccacaaattgttgcacttcttgtggttcgccactatgagtgagccgcatctgttgaattttgatttgcggattaccctgatagttttcgcgtttacctttcagatgaacgactcgacctgcctgaaagttttcgacatctgtatcgcttgcatcccaaaacttcccggaaatctcgccggaagtatcctgaaaattaatggctaaaaacttcttgccgttcttggcgatgcgaacttccgaatctttcaacaaaaaatagccatccacggtttcatctaattgataatcaaataacttctttgccatgttatcccccctaggttaactgctgtacagtcgctgtcttcagttgggtcagtgccgctgtctcattcgtaaagtagagcacttgatgatgctgagcaactactgctaagacttgccaagcagcttgcttacgttgctcatcaaaattcaccaagccatcatcaatcattagtggtaactgagctgcttggcccaaatgattgatcaacgctagccgtaaagccaagtacaactgttccttagtcgccgttgaaagttccgcgaccatgaactgcgttgttgccgtcttcacaaccatttcatcaccgtctaagtcaattttattataccgctgtgccgttaattgcgcgaaaatcgtggttgctgcggccaaaacagttggtaattgctgttgtgtcaatgcctgtagcgccgtatcgatccagttcgcacccaactgccgcgttagccattgacgtgccatgacagtgatttccgtttgtagatccgcctgttgctgacgtagcgtagcgtactggccatccgccgtcaactcttggagttgtgcttgcgccgtggcaatgtccgtagctaactgtgtcagttgctgcaccgtttgggtacgttgttgccgtctttcagccagtaccgcttgcaacgcttcaagcgacgtatactgctttaacgccgatagctcagcagaactgagttgttgctgtaattggtgacgactcgtggcgttggccgtttgcttttccgcatcactaactgcttgcgtcaacgcgtctacatccgctaaaccgttagtcgttgctaacgcctgtagctgctcggtcagatcacggacctgctgcgtcaactgctggacctgccgctggacaaaggcaaagtcggggccggacatggtctgctgttgcatcacttgatggacttgatcatagaattgggcaattcgagtaacacttgtcgttaaatgatcctgatcaacaggaatccatcctgccgcaaattgataaggctgaatcaattgccagagtttggcagcctgtgttgctaatgcttgatcagcagtcgtgaccgcagcttgtgcgcgttgcagtgccgcgactagttccaattgctgtaaggcttcactggcagtcagatccggtgccagaccagcagccactaattgatctgataagtggtcggttgcttgcaccggtttaccctgactacgggtcatcccaaaccaaccaagtagggccacacctgctaacatcaagatccatttaaagccgcctaatggtagcaataatcccgcgacaatcccgattgcaccaccaatcaagcgccaatcaagcgatggactattcggggccggatgttggcgacgcgtgttcgccgtcgctgccaacgtcgccttcaaggtctcgattgcggcctgtttgtgcggagagaggcaacctaacagctcaggatgtgcattactttgcgcttgaaaatcagccttggcagcacttccctgctgggtcaacgtttggtattggcctaaggtttgttgcagggttggtaactgagcttctaattggtcaaactggtcttgatgttggacgtagaagccaactagtccttgagattgtgtatcaactggttgctgacttaattgctgacgggcactcgccaaggcgtgttgcaattccgttcgctgttggcttaattgttgatagcgtgtcctagttgccgtagttagtgtcgtcgtcatattagtggcttgcagttgctgcaattgttgatagaccggccactgatttcgtaaattggcgagctgttgttgttcatgatccaacttggttaaatcacgttgggtacttgtccgttgtgcctgcaaatccagcaatcgattttgtaatgtttcgtattctgggtaccgttgcttggccgccttgacctgttctgtcaacatgcgatagtgctgcaatgcttgattcaacctgggtttgcggccacggggcttatataacgcctccgcatccgtccgtaacgtagtcgccgtttctcgccatggtgcactgcccaccaatccgacttgttgtaattgcacgttcaaatcgctggcgcgcatagttttgagcgccgtcaattcagcctggttaaacgtaaacaatcgcaaatactggtcacgatcataaggcgctaaccacttgtcaagtaaggccagtggttgagcggcctgcgtctgcacgttcaccaaggtagcgggttgatcacctaaccgggtcaaccggtatgtcgtctcgtcaaccaccagctccatcgaaccaccgtactgattcgtaccttgtggttcatggcgttcaagtgggtgacgccgggagggaaaaccaaataacatgccgagaataaaggcccgcattgttgatttaccactttcattgaggccgtaaatcacttgaagcccatcaccaaactcgaactgctgctgttgaaatttgccaaagcccgcaatttcaagacgcttaatctgcatcatcattcacccccgtcgttaaatggtactgatcatttaagagtcgcaccacttgttgttgccaagcagtgggtgacatatcttccagcaacgcggtgttcagaaagtcttcgtccaagagtttgcctgcaagttcagcgactgcttgatcggtcacgacctgctcaccaacttgttgccaggtcgtcgcgttaataccaaacaagggggtcatcgtatccgtcgttgcttgctcaatcgcaaccggccaccaatgttcatttgcttgttcctgcaactgggctagaatggccccctgatttaaggctaattccgccatcgcactcacttgaagactagctggtaacgtaatcgttactaattttaaaccagtaaccatcttcaatgataattgatcagctaactgatggacgatgtgtgaacgggacatgggttctgggctagtgagcgttggcgtccaatccgcccattcaatatcagtcaaggcgtgaaatactggttgcaaggtctgatcggcctggctattcacaatgaggcaccccttcgccccagtttcaccgcgatggcgtccctgcgtgttgccggcatatacgattggtggttgcaaattgagcgtttgccgctgatgaatatgaccaagggcccaataatcataatgtttcgttaataattcactaacgttgaacggggcgtagtggtcacccgccacgccaatctgcccgtgcaaggtaccaatctgataatcaacgcccggggctttaaccggataatcatcaacggggtccgtcgtcacccaccgctgcgcatagctaaacccactaatcgcgacccgttcttgtgccgcagtcgttaaggtagccgttgttacctgcgggccaaaaacgtgcacattggccggaaagtgccagcgacttaaatccgcctgaaaatcatggttaccgaacgatagcagcaccggaatcgcagccgtattcaaccgcgctagcgccgtcatcagtgccgcctgggcctgaacactttggccctgttggtcaaacaagtcaccaacgagcaggacgaaatcgacttgctcagccaccgccaaatcgactagtcggctgagtgccctcagtggtgccgtcactaaccgttcctgcaaagctggtgttaagccactcagtccttgaaacggtgtatctaaatgtaaatctgccgcgtgtagaaatttcatgataacccccactaaaaaaggggcaatcacggaacagattccgtcattgcccctcgatccttaatttacttagttctggtataattcttgaactggtttagtgataatttgatttaaatcattcatcaattggttcaagttacgttctttacccattaaggacttaatttcgtcaacgttgccaaccttatcagctaaatcatgggccttttgaacttcgtcatccgtcaattcttccccattcatctgcttttgtgataattgcatctgaacttcttgaaagtccttaaacagtgaaaaggcactgtcattggtcttcatcgtgtcataagcgacctttaattccttgaattctttagtctgacgtaattcttgttccaattggttcgcagtatcgtaaatatttacggccatcgtgagttcctcctcgaagtatgtgtcgtcattattttagcatttttaacggaacttgaatagcattagtacgttcagaagctagctttactagttgcccaggagactcttggccttggagaaccagtctttagccttattcttaacggcattagcgcccttctcaacgttttcccagacggatgatccgctatcggaactgtctgaatcactactattagattcggtcgccagcgtcgcagcatccttcgtaccaaagctagtattattcgtattcggcaaaatattttgcaattcattcttgaataacgaggaaagttgattttcagataaactcttcaaataatgcgtactgttcgtcgtatcaaatccgatccaggtcgtgaccacaatgtccggggtataagcaatcatccactgatccttcgttcccgaacccgtactgtaatcagcctgcgtactcccagtcttaccagcaaccgagtagccatacggcttggccgcagccccagtcccactattgtacgtgccaagcatcatactggtcatttctttagcaacgctggcggacataattttcttcgtcttagtcttcgtattatcgacaacgacattgccactagcatcgacaattttcgtaataaagtgggccgtcgttttcttaccaccattcgcaaacgctgtataggcactggtcatttgagcaggtgatacccccgtcgtcaaaccacctaaggcaagtgccaggttatcatccgacttggtaacgggtaagccaaactttttcacggattgataccctttattcacaccaatcttattcaatagccaaaccgccggaatattcatactttgcgataacgcggtatacattgggaccgatttactataaacattatcatagtttttgggcgcatatttattggccccaaaagtttgcttcttattagaaaggttcgaatcatacgtataaccattttgtagtgctggtgtatacactgccaacggtttgatcgtcgaacccggctgccgcttaatctgagtcacacggttaaagccccggaagacgtgtttgccccgaccaccgacgacggctaacacaccacccgtcgacggatcaaccgcaatcgaggccccttggaccttcgtaccatcgtccgcgttggccgggaacaacgtactatccttaaaagaatcttgcatctgtgtctgatcatcttgatcaagcgacgtataaatcttatagccccgattcataatgtcagattccgttagcccatacttattaattgcttcatcaatcaccgcatcgaaataatatggataattataaccactttcataatggtagttattcgtcagcgtcatcgccttttgcgaataaagcttatactcacttttggaaagcttattattagcgaccatgttattcaagacgacgtttcgacgagccgtagacgctttcggatgattgattggatcataaccgctgggcgagctcagcattccggccaaggtcgccgcctggtcaacggataactccgacgcgtgtacgccaaaataccgttcagacgcatcctcagctccccagacgccgtggccgaaataagcgttattcaaatacatcgctaaaatttggcctttggaatagacattttcagtctcaatcgccaaaaagatttcccgaaacttacgcgagaaggtctgttgttgtgttaggtaggcgtttttgaccaattgttgcgtcaacgtactcccaccgccactaatgtaatcacggccaatgatcttattgataacgagcaggacaaacgcccgcccgattcctttgactgagaaaccatgttccttatagaaattacggtcttcagtcgaaattaccgcgttctgtaagttttttgaaatactactcaaatggacataggttcccttttgtgaatagagtgaaccggcctttttattgtccttatcatagatttcagttgtcttttctagctccgcctgtaaattaccaactttagccgtcttggcttcataagttaaataggcactcccaattaagatgacggtcaagacgagtacaattagccaccgtgtgatttgtcgccggtgccattggtagccgacgacggcagcgaatcgctgccaatagggtgctaaccaattgccaatgactcgtaagccgtctttgatcgtggcccaaaaaccatttttttgcataatcttccccttgttcagccgacgtacctgtcacaacgtccgcgttacttgttagcttttacaattgtatcataaattttccgatgctcagtaattgaccacaaccttgaaaaaatcttcaacaatcaaacgcaactcattttgtagataacccgatgtttgccagttgttgccgaaatcactgatttaggccacgtgttgtaaccagattaaaggtcactacgataaaacggccataaacaaaaaaagcttccgagccgtccatatgacatacttgaaagctagctcagccattacttgcgccggacaccccggcggttagcgttgagctcattttgttgttgtttaaatttatcgaaggtcgcatcgcgttgtttttgattctttcgaggcgcccgtttcttcgtatatttcatatctcacacctcttttaatgacaataatcataccgtgaacgacggcctagtgcaaacaattagactgctcaccacagtcagtcttcattactaatgtgactagcaaaggattcgtatagctgctttgccaccgtcgtattcggactcacgacaaagatcgtgtcgtgaccagccaaggtcccactcacttctggcaagttcaaatcatcaatgatcgccgccaatagattcccattactcggtagcgtatgaataatattcatgaattcaacacggtcaatgctcgtcaccacatcgtgtagcgtttcaaatagccggtcctgttcatttttgttagttgttttaaaaatcgcgtaccgcgtctgaccgtgctcatccggcgtcttaacgatctgcatctctcggatatcgcgcgaaatcgtcgcttgcgtcgcagcaatgccctctgctttaagcttagccatcaattcttcctgggtagcgatcggatattcactaattaattgttcgataactgcttggcgctctgactttttcatgtcgcgaaacctccccaaatcttgtaatgaatacattatagcaaatattcacttggcaaactacgcacagaacttcaaaaagcacattttccgccactattaggaaaatgtgcttaaacaaatttgtataattatttaaaagtaatgagtcaaccacggttaccagtccactagtaactaatcaaagcggcgtaaatattgccctaataaatccagaccccgttgtaacgtcggcgtatccgtacagtaccctaagcgggcgtgccctggaatatcgaaacgtgaacccggcactaataaaacacctgtatctcgcagtaattgtcgacagaacgtctcgtcatcgatcggtaccattagtttaatacacgacactgaaataccgtgtggcgtgattaattcgacccgcggttcctgtgcgacccactctgtcaaaattttgaggttgcgactgactaattcccgatttcgcgccagaacccgttggcggttcactaaaatcttcacggctagttggtcattcaagacgcccccacagatcatcgtataatcacgatacttccgaaaaatatcagcgatttcttggctcggtgtcgccgtccacccaatccggataccaggcgctgaataggtcttggataaactgttgactgcaattccacgctcgtataaatcggcaattgagacgaacggggtttcatccagtggctcgtagacctcatcggccaaaacgtaagctccaactgagcgagctaatgtgacgacctgttctaacagtgttcgatctagtaaactcccagtcggattgatggcattattgagtaaaatcatctttgtttccggccggatcaagcgttgcagttccataatatccggcaaccagcccgctgactcatgaatatgccaataatcaaccgtagcgcccaatgacttgggaatatcatacagctgctgataactcgggtacagtgcaatcacgtgatcgccgggttccaccaaactatagattgctaaatgattagccccggtcgccccatttgtttggagaacattggctgctggcacttgctcgtataactgactaacgagttctttaaatcgtggtgagccctcaatccagccataatccagccgggccgcccctagttcttcgtaaaaatcctgtggtgcttgttggtcgtctaaagccgcaatttctgccatcgttaaggctgcgattgagctttgactaatatcggtggttgcttcacgctcatgtgcgtttaaccaggcctccactccgaaaccagcaatcttcatgcgtatcgtccctctcataaaaagtccaatacgactagcataccgattgtcagaggtaaccgcaactatattttcgtgatgaaggttgctagcaacttcacgccgtataaaataatgatgccgccacagattcgattgacccaaagtaggactcgcggtcgcatgagatgcttgaatttactgaccaagctggtcaaaccgatgaaccaaatgatggatgctagaatgacccccatcataaagaaatgggtcagcgttgccggaatcgatacccggaacgccgctagtaacacggaaccatcgatcagggcttgcggattcagccacgctaccgaaaaagctgtcagaatcactgctttatacgaaaagtctgcgtcgagggtccccatggccgtcgccttttgccgcaacaaattccaaccaatgtaaaagaccagtaaactgccgatcaacaacacccctaattcgagccagggagtggtctgcaacaatcggcccaccccataaaagcaagccagggaaagcgacgtatcgaacgcaattacaattaaagccacccgcaatgcccgttgcaatggttgttcaatagctgtcgaaaccacaaataagttttgcatcccgattggtgcaatgtaaacaattccaaataataatccttgtaaaaacacttgcatgtttttggcctccttaataccagccaattcgatttccctaccaaccaattattgttcaatcaattggtcatatccgactagcttttaattcagagatgattataatagagataatttcatttgtagccaaccaatttggcagtttttacccaaccacctgtaatcgaacaccaatttccaggttggaaaactaactgcttaaatcgcccacacgggcactcaggaggcatttgccatggcacttttatcaatcaactggcaaccagataaacaggtcgccacacccatttaccaacaaattaccaattattttcaagaacaaatcgcaaagggcaactgggccgttggggctaaactccctgcgcaacgcaaattggccgaacaattcggcgtgaatcgcagcaccctaatcacggcacttgatgaactgatggcagtcggcttaattacgagtaatcccggctctgggatggttatttccggtaaccattggtccagcttattggcggaacacgtcaactggtcgcaatatgttaaagctggccagttcaagcccaattcccacgcgctccaaaaaatcaaccaatttgaaaccgatgcggttattcgtttgagtactggtgaacccgcaccagaacaatttccccgtccactttttcaacgggcctttgctcatctaggcgaacagttgacaagcttgaactatactgagcccgcgggtattttggctttacgccaacaaatcgcacgtcacttggaaaaagttgggattcatacccatccggaaaacattctaattacctccggatcattacaagcgctccagctggtctcaatgtcactatttccaaaagatgccaccatctacacggaagcacctacttacgtcaaatctttacacgtctttcagtcggcccacacccatctcgctggcattccgatggacagtcagggcttggcctactggcagatgaacgcccctacccaaggccaccatgccattctttacacgattccgacattcaataatccaactggaatcgtcatgagtgcggagcgtcgtcaacaagtcttgcaaacggcacaagaacaccgcttaccaatcttagaagacgccgcttatcaagatgtttggttcgatcagcaaccgccacagccactgaaggccctcgataagaccggcaatgttatttattttggtagtatttcaaagtcccttgcaccgggattacgcatcggctggacggtggccgccaaaccggtcatcgatcgcttgactgacgtgcgcatgcaaaccgattacggcgctagctcactgtcacaacttgtactggcagaaatcttagctgatcctgaatatgaaacgtatcaagctgatttccggtccgtacttaccaataaggccgcggcggcagaacaaattctgcatcattactgggacgattttgcgacttggcagacgcccacgggtggcttttatctgtgggtccgcttagccgacaacattaatattcccaaattattcgaccttgccactgcgcacaacgttctcttcaaccctggtagtatctacgatttccagccgaatcagtacattcgtctgagcttttcttatgaatccagcgaccgctttgaacaggggattaaaattctaactgatttaattcacgccaattttaacgtttaatcaagtaaagatttcgttaatacacctgattaaccatcatcgatgataaaactatgctagaatgaagactgaataattcacaataatgataaggggcgtattttgatcatggatgatgttaaagcaacggtactatcgatcttgcaagatttaactggggaagatgtttcaaacaatatggatgccaatttatttgatgaaggtatcttagattccatgggttccgtacaactgttactggaacttcaaaatcagcttggtattgaagtgcccgtttccgaatttgaacgttctgaatgggaaacgcctgctaaaatcgtagctaaggtcgctagtttacaataaataaaaattcaaatcgccgttaagcacgctgcttaatggcgattttttaattagctggaaaattgtctaattaacagctgatttactgcaaataaccttaatttgccgatttccgacattacccgtggcaccagtaataacggctatcacaactcattttggaaaattttacgaaaatgatatgcaaagtttacacaattttgataaacaaacgttcgctaactgagtaaactaaaatcactaaaatcatttttgtaagggatggtattttgaaagtcagtgttcatcagctcatctgggtcacgattggcgcaattagcttaactatttttaccggattcggacacctatttgcccggcaccaccaggccattgccagtaatcggccaatcactaaagttagtcattcagcaactaaggtaaccacgccagtccaggagaccgttgactggcataagccctccctgtcacggccgtatcccaaactggctaaatacgatgacatcaacattcaggtttcaatcagaaaacagcgcgtctacttaaaaaaccacgatcagaccctttataccatgcttgcttctacgggcaaacatggctctgatacccccaaaggacactttgaaatccaagctgaacgaggacaacacttttttaacacgcaatcgggtgaaggcgccaattactgggtctcattcaaggatcatgggatttacctatttcactcagtcccagttgatgctaacgatcaatacatcgttaaagaagcccagcaacttggtaaagtcgccaattcacatggttgtattcgcctgacgattgctgatgccaaatggctctatgaaaacatttcaacccatacaccggtggttgtcagttgataaaaaaagaatttaggccacatcctaatgaccgccataacctactctgctatctccgtagcatgttaattaccttttttggcttctatggctttacttacctagtcacctggttaacgattgaaaagaccggtaatccccagttactcggcaacgtcatggcgatgacaatgctgccggcaatcggtctgaacctagtcgctggtcgggtacttaaatactactcagccaaacaaatgatgttcattacggatattttgacgggaatactcttcattggtgcctattacgcactaaatacggttagttggcaaatcacttgcttagtcatcgtcgccgttctcaataaatcaattggggtcttttataagctcagtaacaaaacgattttgccagacctttttgcgcccgtaaatattcaaatcgtcaacggctatcaaactcagattcgccagttggccatcgttagcgcgacaatgctcgtcacgatggcattactatggataacaccggctaccctcatcttaataatggggatagcgttcttggtttcagccggtctcgattggcaatttcgaacacgtttccatcgctcctcggattcggttatgaccatcaagctagaacgccatcaatcatggccgcgatggtcgttactgtacgccgttctcggttatctggtcgacgcgacgattgctgtggccgttccttggctcgtcgtcagcaagttgcatagtcactggccgcttagctggttcttaaccgccaacgccataggtatcttattggcaccaatattgctaaaacgatggtcaaaacaatccctgctaactttgacggccttcaccggagggtgcttattatttatgtggccgacctttaccagtcttatgataaccatgttcttgattggtgcattacgtggacagaccaacatcagttttttcaccacgatccaaaaaattcccaccaacaatcgtaatacgctgatgacgggggtcttaaccgtcatcgacactactaccgttattggcagtttactggcaccccgtttgatcttaacgctcggtgcttggaccctccccttgcttggtgggggtatcctcttactttgtttaacgcggctaattatcttattgaacaaccaaaagcagtcttcatccgatatcgacgaaaactgctgagcaacactcatttaatttgagaccgggggacccagatcttgaccattggatgcaatcactcgctgataccagtagaaagagtccttcgggattcgggccagagttccactaccatcgtcttgacgatccacataaatcaatccgtatcgtttagacatttgccctgtacctgcagaaactaaatcaatacagccccaactggtataaccaatcagtttaacgccatggtgaattgccgttgccattgcttgaatatgtttacgtagatagctaatccggtatacatcatggatttgaccatctactgtcaaataatccttggcacccaatccattttcaacaaccattagtggtaaatgatatcgatcattcatcagctccaaataatattgtagaccagccgggtcatccgcccactcccattcagagtattgtagatatgggttacgcgcgcccatcgaaaaattaccgccaacagttgcactgacctcatgtgttgtaactgccgttgacatgtaatacgagaaggtataccagtcaaccgtaccggctttcaaggcttctaaatcactgtccgtaatgtctaaatcaacttgatgctcattccataaacgtcgtgcataggttggatactgtccctggcactgcacatcaccacagtaatagatgttttgttcccagacgtaccgattctgcaagacatccgccggatcacaggttaacggataagacgtgataccgcaaatcatgcaaccaactttattttcgccatcaatcgcatgtgcttgctgtacggctaaagcactagcgacaaattgataatgtaattgttgataagcgcgttggtaatctgcatcaccggctttggcacgcaatgccagaaacatgatcgtattattaatttcattgaaggtaatccagtgctttaccagcccacgatacgccgtaaatagcgtttccgcataatgctggtaaaaaccaatcatccgacggtcattccagccaccatacgtttcctccagatacagcggcatatcgaagtgtgaaatcgtcaccaatggttcaatttcatattttttcaaagtttcgaacacccgacgataaaaatccaaccctgcttgattaggttcattttcatctccgcgtgggaaaatccgtgaccaggaaatcgacattcgatacattttgaaacccatctctgcaaacagcgcaatatcttcttgatatcgatgatagaagtcaatactagtctgattaggataatagtcatctggcagtaccgctccatgtgctccagcaggaattgaatccccttttccaagagtaccatccgcttgcaaataagtgacttgccgtcgctgattaaggcctcccattgtcgtaatatccttcatagtcaggccccgaccatcaacatcataagcaccttcgcattgattagcggcagtggccccaccccagtaaaaatcagccggaaattgcatattcacacctctttctcagtcttcacaggttgcatggccgcgttatcttgattcgaaactgccgcccgcttttcttcagcttcaactgccgcctctttggcaatcagttgcttttcataaactttaaagaagggataccagataagcgctgacggaatcagcatcaaatagtcagtcaatgcgttgcgccaactgagcgtactgagataacttccaaaacccatgggtaaaatcgcggtaattacaatccaccccggtgttaaaaatccaatcttgtatagtacgagtgcacacaacataactaccggaatattcaggacaaacgggatactcataatcggattatacataattggaataccaaaagtcatgggttcattaattttgaaccagccggggataattgacagcttaccaacggcactcagctgtttagatttagaacgcatcgccattagcgctaacggcagggtattcccagttccacctgctacggtcataaatgagaacaacatcacaggtgcaaacaccaccggcttcccagctgcctgcaatgcggcattttcagaaaccgcttgaatcactaacggcatcacaattgggactaaaatcatcgtaccatgaatgccaaaggtccataataaagcacccaagatacacaggacaaaaatacctatggttgaagtcagtgcactcagtggaattgccagtaattccataaaacccgaacaaatattatacttaccggctgttccaaccgtgactaataacgatgcgcccaagaaaatcacggcgttaaacaataatggcacaatggatgcaaaaccgtcttggagaaattgagggactgcatctggcatgttgattcgaatattcttgtctgtacataatttctcaacgcggacggaaatccaaactacgacgaagccaataaacattccctgagcacctaaataggtcgtatcaatgctaactgttccagtcttactgacaatcaatccaccggccacaatccaaaaacccaataatgcgtcaatcgcattcatgattggggccgtcatttttaaatttttggcgtaatgaaatcccaagaataaaacaacccaaattgataaagaattcattgagaattggaatggaatcttcaagtaggctaacagaatactctttgctgataacacgccaaacatcgtcggtcccagtactgacatcgtgatttgaaagatcgcgccaaccattagaatacccatcaaagacatcatagctgcctgtaatgcggtaataaacttattattgccaagtccctggccggcacgttgtagtccgaccatcagtttactattaaaaaagcgttccatcgtccttcacccccgaatactaatccctcgtcatcacaccaagttctcggccagtttaaaaatatgggcgctgtcgcccaccgcatagtccaatggtggaatggcggcgacgggcaaccccgtggctttttcaacttcactctgccgataagctacttgcggtcccatcaaaataacgtcatagtcctggtagacatcttcgtacgcagataagccgactgctttaatttgtccggcaacgccttgttcgtcacgatactgctgtaactttttcattaagatgctcgttgacattccccccgcacaaactaataacacgttgattgctttcataaaccaaccatcccttcaaatttttgagacatctttaacatctcagcgattaactcgttagctaacagacttgtcataaaatgatcttgagcatgaattagtaaaacatcaatggaaatctgttggccacccgcctcagccaccagtagttgggtttgaacatcatgggctttccccagcgcttcactagattgcttcaataacatcttagattcggagaaagcatcacgatgcatcgcatctaacgcgttaaaagccagcgtgcgtccttcaccagaatatgcaataagggccattgcgatattttgagtttctgtattattggctaatgtcattatccggttacctactttctgtatttgtcgacaaacacatcgtaacaagtttttttgtcaatcacaaaagcgcttacatattcttgtgtatagctttcaacctaattaattgaccggattgacactcactggcatcaaaataaccagattagatctaacactcggtctcctcactattagtgtatagatttaactactaatttgaaggttgtgtatagctgattcaactggtgtatagcctacacatttgaactcgtttttatcagccttgaactaacacatgagtctcgctataatcgaatcatgaaaatcattcgcacacttgccgtcacgaatacggaattttataactggttagaacaacaactactcacggagattcaaaccgctacgggtcaagtactcacggctacgtcaatcaagaaaggactaacctatcggaaaacggccgccaaaacggccgctcagattaaaattatgattgatgattaccaacgcggtattaagtaccaaatgacagctgtttcaccactagataccgtcaccgtaacctatttaaccactgatgaaggtgctcaaactaccgtgacctttctagaggacgttgacagctatcgaccgcaacaacaccattggctactcagaacctttagtcaggcaatgctccttgggcggatgtctgacacgttgctacagcttgaacaacaaatcattgatcaccgaacgaccagtcatcaagctatccaaccatagacatttcggcaatgattcagcctttcgagtcacaggaatcaatggcctactgaatagtcacatcaagcaattacaaccactcgatgcgactatttcagctttgttagtacgtgctccgtcaataccagaaccactatcaatacttgcccatcattgcccgcttcgaaatcaaggttgccacctccctgcccaacaatctcaaccgattgctcatttgaactaggctcagcgcaattgcctcaagatgacgagtaacgttccaatcatctcatcattcacaatcagtttgaatgtctgttcgattggtcgtagacaccgtcgtaactgttgataatcatccgaatactgagttattaatttccgcgttgggggcgtagtcgtttcagttttgccggccaaaatacgctcaatcatgctacccaagtgaacaaacaggccaatttgttgatcctcagttagttggtataaggttgtcaagtcgtccatgagtggtggtaacacacgctgcaacttagcaacttctgcatattcaaactgcgtcttaaaatactgatagatctgattataagtatcccagtgaccagcttccggccgaaacatcagtacctgatctaactgctgatgcgagtgttcaaaaactgttgccatcgaaataaacggaatgccgaatagttgaggatcaaaggtgccgacaaacgcatgaatctgataaacctgttgtaatctaagtacggtcgcgaccaactcatcacgatgtccaatcgctaacgccttgacgcgcatttgcaatcgtgaatacttatcaatgtaatcttttaattgcgctgcacctccctcacccgtatgacacagcgtgatgatcaactcatctttggtcatctttttagcattcaattgttgcaggtcgaccttcaccaggtgataaacgtcatctatatccgttgcgcgggcactctttcgagcagcatctaaaccgaccagggtcactggaatttgaatcatccgaattttagtcgagagttcaccttgaatggtcgtcaacatccatttgattgctcccatatcataaatgattatcacacccgcgccaccatcaatctcactgattttatgcttcagtgctttcatcaccatcacgctatcggctgctaggtcaacatcataagcataagtattattaatcatgctgagtgtgttggttgttcgcatcagggcgctggcagttcccattccatgcatgacataaagcacaaccggatgctgtcgtgtcactggtgattgcgcaactaaaaatgtcaccaatagactgacttcggccgttggaatagataggttaagctttgtcgctaaaacctgtgttaattttactgctgcctcatattcgaccgcatactgtgactgtaattgcgcggccgttgtcagtgaggcagatttggtcattggcatttgctgatatattccattaatatgcagacataggccattaaacacgctctcagtcaacggccgtcccaataatcgttcacaatctggctgccagtccctgacaatctcaataattattggagcgacgatttgtgctaagttatgcgtattggattcaagctgttttccgacatcttggtcaatcactgacagcgattggtcggcgctggtgttcgactcggcctgttgccgtcccactttcaatgaacccaaattcaaattagacgttgtattagtctcaaacgataagtcagccgtttccaacacagccgccaattccttttgatagtctcgttcttgcgtcaatgcctgttgcaccactggtgataaatcagcaaagtatacgcgaacttcacggtcagtatcagttataaaacgaacataggcctgcgcacaagccatagtaatggtcgctttcaacgtttttaaattctgatcatagttggccaacatgagtgccctggcaacatctaactctactcgaatcgttcgcttggattgttgggcttcaatggtcaaaaaatggcgaatcaacgcccacctttctgaccacggtcgccgcttgaaatccggtaattcaatcttcattatcaattgttgtgtaccgagaacttgctgctcaactccgctgactaaaataattaacggtggttgtttgaaagtcgctacggtttccatgacagtcatcaattgagcacgctgtggaccatctaaatagtcataatggtcaatcacgacaataccaccctggcattgccaccacagactgttggcgaactcaccatgctcaccaaataattgactgtcaagttggtgaatgtcgtcagcataattacgacaattaacaacagtggtgctatcagcggccgtcagcatgccctgttgcctagcaaaatctcgaatttcatgcacaaacgcggtactacccgccccatcattcgccgcaatgagaatattcaacggaccgctgggatacagaaccgccgcttttgcaagtttaattgcatgttgcaggctgttcagactgccaattagtcccgtaaatggttcttgggagcctgaggtagctaacagaaattgtactggccgcgtcttagtcttgactaacttgtgttcgcgcactaatgcattcaaagccgcgctaacatttgtgcgttgcattttcaattgtgtcgcaatgaccattgctgtcacaccatcgtgataccgcgtatccgttaaaaccaatttgcgtaccatatcataaataagctctcgagtcgtttccatttagatttccccactaaatttacatcactacttttataccagacttgtacattttttgccgtgatttgccatcgaaaaaagcacccgttgctcatcacagcgcgtgtcgtttcaatcaatacttgtctacaatttaagccactagtttcgtcaaaatctgagcagcatccgctaaaaccttttccggatgctgccgtgcgtccgccaacatgcctagtggctccaaatccaaggcagcaaattctgcgtgccgagtttgaaattgacgatgaaatgggagcaactcactagccgacatcgcggatctaacggccaccggtgccggatagcgattcaatacggtatagattttcgggttggtaagtgtgtactccatgctaaattgcaatgcccccaaatcttgatacaataacgtactgacatccgtttcagtagaataagtcaaaatgatttgttgtgccaatggtaaccaacattcattgagtaaccaggtatagttatcgtgttttggccccgtcgaatcaagatcgatcagcaaataatccgtctggacaccctgtaatgcggcccaaaagttgttgagctcattagccgtccgaatgtctgactgccactcatagcagtgatgcttttgaatagtccgccatgtgacggtttgatagttgcaactaacgatggtgaccgtcattttccaattggtcaatacgttcgctaacgccagtgttaacaagctcttgccactagcggcttgcgttccaccaatgactagtgtttgtggttgtttcctcaaaacaaaaccctccttagcttaatttacaccaacagcatacccggacagtcgctgaattgccagtgttttgcatgtataacaggggggacttagggctttttatgagaagtcactgataagtttgttggcgaattaattcactcgctgaatgagtcaagtagccgatggaataatcgcgcctaagactgacaagacacggttttgcgaaattaaagtaagcgttatcaacgcatagcaaccaatttagacggatacaatttaattttgcaatcactattcatctccccgaaaattagtttttactaataatgtttagttcagtcaattaactaaccagtaccggactttgttctccaccgttattcagagcacacatcagataatcacgcccaagtagaatagtgaccgaattaaaattggcccgactagttatcaaagacctcgccgagccaatctagttttctccatctgtcaacgtcctcgacaaccttatccaatctcgtaatcgctcacacaaaaacacgactatatacacggcactgcggaatacccgctacagttactggcaattattccgcggccagagccttaattgggttggcccgtgctgcccgccgtgccggtaaaatggccgccagccaggcaataataatagcaatcacaaaaacagcaatcacgttactgagttgaatctgaaccagcgcgtacccgcccgttaacttagccagcgcatgattaagcccccgctcagctaggtaggacagcccagtcgctaaggtggcactaattatgcccagcatcagtgcttcgctagtaaacaatcgccgaatgtcacgacgccgctcccctaatgaccgcagaataccgatttctcgcatccgcgcactgaccgacataaacatcgtcacgatgatcattaatgcggagacaattaacgaaatcccggcaatcgccgctaacactttggccgcaatattaacgtaagtattgaacgaatccagcgtggccgcgatactggttgccgcaaatggctgcttaccattgatcgataaatgattgatttcattaaccacaatctgattctgttcccgactcttgattctaacggtgacaaacgtcggctgcgtcgaaacccgtgcggctgaacgcattgactgcatcgtgttgtaattgacagcattcagaccgacttctgaggtgctatcaacgattccggcaacagtcaatgcgcgcgtcaccgttacgggctttcctttttgatcaaatgtctgatagctgaccgtcacggaccgccccactaactggcgccaattggtggccgaccatttctgagcgatggaagacttgtccaatacaatctggttgtctccggccacgtggcccgctttcaattgccgggtcgggtcgctactcgtccaagtcgtcagctccggtgcagcaaacttctgttgtccgattgcaatcgttgcattcgtcgctgagatgccaggttccacgtcagttacgtgcttaagattccgtaatgctgtgagctgcgtgtcggtgaacacgggcattcgcgcggcgatgccaccagcgacggccggatcataaacggccgcggcctgctcatcacgatccttggcgttatctgcttgatgcatgaccatgattgattgcggatccactaacgtattcatttcgtggttaatatagcccttaatgccggtacctaggccatcgaaaagcatgaccgcaaatagtccaatcgcggttcctaatacgatcaacgcattccaggtccacgtgtgtcgcatatgcttgaaggccatcatgactgacacgcgccatggcagcggccgcgcgggtaatggtgcaactgttgccgtgaccaattcattgttggtcgtcagtggttgtgatttgatttggccgttcaccaactcagcaattctagtcgcggcacccgccacgcgctgtgaatgggtgacacaaatcaccaagcgcccctcccgggcaattttttgaagcattgccatgacatcggcagtattatcagcgtccaacgcaccggtcggctcatcggcaatcaggattttagaatcaccggccaatgcccgagcaatcgcaactcgttgtttttgaccacctgataactgttgcgggtatttcttgatttgagccgtcaaaccaacgtcggccaggagatcgtgtgcccgccgcatccgttcgctatggcttaacctagtcatatctagggctaacatgacattttcaagcaccgttaaatgactgatcagattatagctctgtgaaatatagccgataacttcacgccggtactgatccaactggcgctcatgatgataatcaagcggttgtccagcaatactgacgctccccgtgaagtcatggtcgaggcccccaataatattcatcaaggtcgtcttgccaccacctgactcaccgacaattgccacaaattcaccgagttcaaactgcaagttaatattctttaagacgttgaatgtttgtttgccaacctgatagttcttacaaatattcgttagttccaaataactcatcaccaagcccccaatatggcattttgaattagcttccagaataccacccctggctacgaaactggtcataaaaattttagtatcgtaagttgccttattaagattttaatgtttcatgccatcaccatcacggcttataatcagacgtaaattaggcttgagtttactacctcgaactggtcactaagttggtgcttgtcaaccagctagatcattcacccaaagtaaacggccaagccaccaatgggaggggtattcatgaaaaaagttttccgcttaatcggttccgactacattcgttgcgcgatttttttcgtaattgctttttatgccgtcaccgcagatcccagcggccggtttcacctacattggacgttaatcaacctctatctgacttcggcatacttgttcggccacccactcctaatgtgcctattgccacgacttacccataacccttttcaaatgatttcagtcgcttcacgtgccttgaatgatgcgaccggtcaacatcaaacaatcactcaaatttatcataacgccgtcaatcccgtcagtagccgtgatatgttgctctctcaaaatgaatatcgtgacgatatgatgtcgatcagcgtttcctttgtcattcatggttgcttattgttattatcgtggccgttaatcgggctcgttttactaggccggggcggtaaagttttgatccatcgactgatgatccgcttcacacgataagtctggttccagttacaagagtggggcgcagctacctgctcgcgatttctgcgattggttcgcaacttgccttcgctcgcggtcgtacatcgaatcctgtgccgctatgaccgcaaccaaaaaacgccacgcatactagctcggctttaacggccggtttcgcatgcgtggcgttcaaacttgaacagttaattctaattacatttcatcgggagccttaacgccaagtaagcgaagggcttccttcaagacgatgctgacactcttgactaatgccaaacgtgcgtttaattcatcatcttcaactaagatcttggtgttagcataatacttgttgtatgccttggctaagtggatcgcatacttagcaataacggatggttcgtattccgtgctggcacgtaccacagttgctgggaattcactcaataacttcaaggtatcccaagcggctgggtcgcttaacgtttgaccagttaccgcaatttctgggctaccggctttccgcaagatactttcagcgcgtgcatgggcgtattgtacgtatggcccagtctcaccttcgaaacgaacaacttcttccaagttgaagtcaaagctgttcatccgttcgttcttcaagtcatggaagaccacagcgccaatcccaacggcatccgcaacttcatccttgttaggcaagtcgggattcttggcttcgatttgctcatgcgctaacgcaaccgcatcgtccaagaccttatcgagcaaaatgacccggccactccgagttgacaacttcttaccaccagaagtaatcaagccaaatggaatgtggtggatctgatcagcccagtcaaagcccatctcagtcaacacagccttcaattgcttgaagtggttggtctgttcattcccaacgacgtagagggactgcacgaaatcataagtccgtttccggtagattgcagcggccaagtcccgcgtgatgtataaggtcgcgccatctgatttcttaatcaatgccggattcaagtcatacttgcttaagtccaccacttcggcgccttggctttcttgcaagaggtgcttatcctccaagatgtcgacaacttcttgcatcttatcattgtagaaagcttcacccttgaaggaatcaaagtcgatatccaaacgttggtaaatcttcttgaacgccttcaatgattctgagcggaaccacgaccacagatgagtcgcttcttcgtcaccattttccaacttcttgaaccattcacgggcttcgtcgtccatttcaggatggtccacgtcttctttatgaaaacgcacgtagtattttaataggttattgattggatcagctttaacttcagcttcgcttccccacatcttgtacgctgtgattagcttaccgaactgcgtgccccagtcacctaagtggttgatcttaactggttggtaatccaacttacttaaaatatttgccaatgaattcccaatcactgttgaacgtaaatgacccattgagattggtttggcaatgtttggcgatgacatatcgatgggaacttgacccgcttcaccgagcttagcatcaccaaaatgaccaccattcgccaacacttgatttaaaatatcggccgcaaacgcttcttttttgaagaagaagttaacgtatggtcccattgcaacaactttttcaaagtcactgccatcgactttttcgacgatgtcgctggcaatcatctggggtgccttgtgtaacgttttggctaaggtaaaggttggaaaggccaagtccccctgcttagacgtctttggttgttcgatcttgtctagaatcgcttcctgcgttaaatctggtagtgctggcgctaaggccgctgcgacgagttgtttataatccatattgtcctccttgactgtcttgcgggacaaaaaagtccctcacatatttaaaaacatgtaagagacgagacgtgcccgcggtaccactctaattgatatgacatccacttattatcgaattgtcgtcttcaaaagcgcgcttccaatgatgcttatattcggctcccatcatcccgaactcgctggtctaagcattcatcgtactattctttctcattagacgtatatatttttaccatgcgttagtataacagaattcaaccggtttgactagttcaacgttaaaatcatatcctgatgcggaatcccatcctctaaataaacgtcagaaactggttgaaacccgaatccacggtagaagcgatccaagtaatgttgggcctgaatattgatttgtgtcgttgttggccacaacgcttgaatctgatcgattgcctgctggagcaactgctgtccgtagccgtgcccccgcaccgccggattagtgatcacccggccgatacgggcctgctggttggcttcacgcattaagcgtgcatatactagcagccgtcccgttgaatctagcccccgtaaatgccaagcggttagatccgtatcgtcgacctcttggtacggacaagcctgttcgacgacaaaaacggccacgcggagcttgtaaatctgttgtaactgccgaacggttaactcatcgaacggcattgtcgtaaattgcatgttatctccttaatgctgactattgaccactgagtcggccaatcattaatcatccagacttttatccaataaaaaagaacgggtcatcgctgactgacgttcttgattatcatcatctattgacggtccgtacgagactcgaactcgtgatctcctgcgtgacaggcaggcgtcctaaaccaactagaccaacggaccatgcgctcaaggagcttgagaatacaatgactattaaccgaactgattaatagcaaagcgggtgacgggaatcggacccgcgacgcaagcttgggaagcttgaattttaccactaaactacacccgcatttgacaacagaaattagtatagcatacattttttctgttgtcatggttatttataaatttttagtcttctttttctgggacaactttcggctttggcgccgctttaataagcttagcatcatccttacgaacaactgcgcggtggttatactcgttaacaattggttcgtcagctttttgaaattctttaattaagatcaagactgaattttcatacactttttcaatttcgcccttgaaatcgtgttccaacgaagcaaacttcttaccagcgacgtaatcgccaatttttaattctacggccatttgtaaactccttaacgtttttcaattcatgccccgtccataggtgtccgggagattagatgagtgactttaaaataaaattgataacaaatattatcaaataatccgcttggttgcaagccttaattacaatttttcagaatcgtttaatattggttcggccccttctgcgaccgtgtttgtcatgcgggcctgttgccgtaaatcgtggaccgatttgatgtaagcaggcaacagcacggcacacgaccctaaccaagctaacggttccgaactacaagcaccggcgtaatcgaagatccgaactaagatcagcgccgcaaacacccgcataaagagttccgccgcgcccgccaaggttggaatcgcgctgcgtccaagcccttgcaaggtattacgcataataaataacattgataagaggatatacgtacttccgatgacgttaaaatacgtctgggataagttcaataccgccatgtcctgatgaccgacgaagaaccccacaagctgtttaccccaaataatttcgatcaagccggcagccacactaaagctccccgacaaccacatggtctgcttgacccccgtgataatccgttcatactgatgcgcgccataattctgagctgcgaaagtcgccatggtgaccccaaaagacattaatggctgagtcgcgacttggtcgattttctgagcagcagtcgtcgccgccactgagttagtaccaagactatttaatgccgcttgtaacacgatcgttccaatcgcgatgattgacatctgaaaggccatgggtagcccaacattcaggtgagccttcacttccgaccaaactaacttgaagtggcgccgtccaatgtgcaagatgggtactttgacgatgatgtaaaccacacacatgagcgttgcaatggtttgtgctaaaatggttgcccagctcgccccggcaatgccccatttgaaaaccaagatgaataacaattccaagccgatattaattaatgcgctgataatcaaaaaccataacggcgtgcgactatcaccgagtgcgcgaatgatgtttgacaataggttgaacgcaattggtgccagcatcccgccaagcataatttgtaagaacgtccgcgcatccgcaatgatatccgtcggcgtttgcatcaacaacaagatgtggtcgacgaagatcaacgacagaatcgtcaaaataatcccgacaatcaaactaactacgatactaatcgcaaaactgcgccgcaccgctttaaaatcacgtgccccaaaatgttgggctgttaatatggataagccagcggttaacccctgtgcaaagccaatgatcaaaaactgaacactcccagttgatccaactgccgctaaggctttaacccctaacgtctgaccaacgatcaacgtgtccgataaactataaaattgctgaaaaatgttaccgattagtagcggaatcgtaaaccaaaaaattaattttagcggtttcccttttgttaaatcgttcattttcgcactcctttcattaattaagatggcgtacttgtaatcgttttcttaacgcttgtcatacaagcaaactttgctagtatatcaactttagatttataatactagccctttgttcgtaaatattaaatattttattttgatcagtaaattggtcgttttcgtttgctttataaagccctttcaccacaccgaagtatcaccgcttttatgggcaacgcaaaaaagcttgtcagcgtgcgctctgctcaacacaactattacataatatcatttcgtcatttccttgtcaacaactttatttaagaagttgaataactatgcaaatgatttgaaacgttattaccataatataatcggtgattcctcaaccgcttgagcaaccgacgcgacaagaaccatcttatcattagcgattattcatgtcaataacttttttgatgtttttgaatatttattcataaacaacattttgaaatgaagcgatgcaagtgcccgtggctagctatttaacagctgagctcgcggcgacaagatatatattatcaagtattagtatgcaggtcaaccctttatttgaatttattttgataaattcataaacggtgtcgtttcactcacgtggacgctcgcaaacagctcatgcaacttgcttgctagtacaaactcaaggccctgctgttcaaacttagcacgtacctgttcatcaacaataagatgatcaaatacaaaaacggcaactttttcctgatccagctcggccataacagagtcgtacaagcgtagttggtcaacatcaataccgattgtatgccggaaatcccataacaccgacgctaatggtgagcaccctgctcttactggtagctcataaaagttatagccacgaacagaaggcttaaccaaaaaatgtgacccttgctggtcattgtatataattgttcctgcaacttgcttttgcactaatactcacccgccttcagtcggttcaatgaatctgacgtccaacgcgctaaattattagcgatgggttcaaatcctgcatgcacgtgccgattcgtccaaaaatgcttgtggcggaacgtcttgtagatttctagatcattgaccgtcggatgcggttgatgctcgatacagcgtaacgataaactaattttgccggtatattcatcaatgtccaaaataatgacatcgaccgcttgaccgactttcagatactcagtaatactcttaacatacccttcgtgacactcagaaatgtgaattaacccctgatgttcaccatccaaggtgacaaaagcgccataaggttgaatacccgtaattcgtccgtgcacccgcatgccgattcgataattgctcacgatattaccatcctttctcattcattctgcgtttcgtaaaaattataatccccaatattataacctgaatacaacggattgcaaaatcctaattataaaaaaagaaatccgcaacggcagatttcttccaaacgtaactaatcttcaattgtgatggtttcaatcacgacatctttaactggcttatcctgcatgccagtctcagtagccgcaatcttatcaacgatatccatgccatcactaactgcgccaaaaactgtatgccggaaatctaaccaaggcgtcccgccattaccataggccgtcacgatttcttctggataaccagcttgcttcatctgatcactcatcccagcatctaattgtggcttttgaacgatgaaaaattgactaccgttcgtattaggaccagcgttggccattgataatgcgccccgcaagttgaaaacttcttgggagaactcatcttcaaatggtttgtcccacaaactttcgccacccatgccagtaccagttggatcgccaccctgaatcatgaaatcaggaataacacggtggaagatgatgccatcatagtaacccttctgagctaaaccaacaaagttttcaacactctttggggcctgctttggaaatagttgaaccttaatatcaccaaagttagttttgattgttgcttttggtccatcgacctgacttaaatctaattgtggaaatgccacaaaatcacccgttttctattaagattaacttgataatacaagagaaccgaattaaatgctagccatttgtaaggatttcttgcgattaacgactaagcatagtatttcaattcattttctggtaacctagataggattaatttcacattacttggaggtaaccatgagttttttaattgattttgtgttgcacatcgaccaacacttagtcaccatcgtgaatagttttggaatctggacctacctaattctctttgccatcatcttcattgagacaggcgcggtcattttaccttttctacccggtgactcccttttatttgcagcttgtgcactcgccgctaatccaacctatggcctacatatctggacttttgtcattctcttcttggtggcagccttggcgggtgactcacttaacttctatattggtcactccttaggggaacgcttaactgaaacatcctggtttggtagactgattaatcagaagcagttagccaagtccgaaaaattctttgaaaagcatggtggtatcaccgtgaccattgcacgcttcatgccaatcatccgcacctttgtcccgtttgtagccgctagttcacgaatgaaatatcaacaattcatccgctacaacgttatcggctgtgccttgtgggtcattctctgctgtggtggtggctactacttcggtaacattccgttcgttaaggaacacttctcaatggtcgtgattggaatcatccttgtctcactgattccagccgttttctctgccatccgtgcccgtttcagccatccaactgaaaacgaagagtaactcaatccaatcacaaaaataccgaccagctgatatgagctggtcggtatttttcattcaatctaaaactcaatccacaccgcaaccattccgaactaatcagccgcgcgtaacgcctgtttcccgatactgagtaagtaaataaacgcccactccaccaagataaacgccagaacaaagcattggccgaagaacgtatccggcaagactaaaataattctgtccaggagcggatcaaacaaccagtccgaattacggaagaggatcttatggaatatgataaagaactgatcaaaattgatagccattataacggccactactggtggcacccagagggccgtctgcattggcaatactaaccgccacaattggcggtcccgccgtagtcgctgccaaaaaaagtagacaacgacactcgtgacgataaagaccccgtaatcaagcatgaacagattcttgacatccgcaaagtgcactaacgcacttgtcgaatccgtaaaatcattcatagccaatttgggaacccacggaaaattaagataagcgagtaactgatagtaatttgtcatcaactggcccagtgtcaaattcacagtggcacccaaccgctgaccaaccgcgttgacaaaatacaaccagctcgcattaattgtgataattatcgtaccgctcactagccataagtagacactaagccactgaaccgtatttttgcatttatttaaccacaccatcgtctaggtcccattcgtccaaagagttgatctcgttagttggtttaacggtctgttgcgccactagttcgggagttgacacgccggtatataccaacaacgagtctattccaaagttaatcgccgctgagatgtccgtcatataattatccccaaccatcacacaatcgtgcttatcaagcccaattcggtcgaccgctttctgcataataatcgtctctggcttaccaacataagtggcccgttgttgagtggcccgttcgaccatcgcaatcaccgaaccggcacccggcactaagccccgttcatttggaaggttagtatccgcgttggttccaatgaacttggcgccgcgcttgattgcgagcgtcgccagctcaaatttgtgataagtcgcatcatagtccagaccgacgatcacaaaccggggcgtttgctcatcgaatttgaagcctttttccaacatggcccccttcaacccgagctcaccaatgacatacatcgtcttatcaccgtcaccggcaaggtcgtcaacataatccgccgtcgctaaggccgccgtataaacgttggcgggactcacatgaatatcatgattatccgctaggttagcggcaacatcctcaggtgatttagtggtattattcgtcactaacaaaaaatcagtctgactagcctgtagtcgttcaataaaccgtttagcagcaggaatccgttcccgaccacgataaactgttccatccaaatcaattaaataacccttgtacttacccaatcaaaatacctctctctgttcctacttttgtcgaattgtaaagtggcgcttaccactactctgcttcgttgtccgtgcttgattaccgttgccagccgtgactttcgccggttgccgccgcttttcagtaaacggtgcggccttctgcttagtggtaaaattatgcgactttcgccgttgcttactgcgactactactacgattactgcgagcacgggattgccggttagtcgtattcttcttcccacgccggtcgtccttacgtggccgactcgcgcgtttaggtttgatgacccgctcatttttaacaataaagtaggcgcaaccaaagttacaatattcgtacagatagtcttggaccgcaccgatcgtctgtgagcgttggacatccttcatatcatcacggaaaaagcctttcaaccgtaattgttcaaatccccaatcacccacaatataatcatacttatttaggattgagctgtaacgctcaacgaacttgtcgaggtcaaacccttggcgataatcatacacgatttcaaacgggtgcttgctaacttcaaagtgggtcttatcagttcgtaacccatgatacaaattacgccgccgttccgcttgttgttcagctagttcatcaatatgttcgcgattcacattgacaccacctttctcttatttaaccggccattgacgcgctaaataatcgccaacgaccgttcttaacattgcttcaaataatatctcagttcgaccactgatgttaatggtcgggaaaaacggaatgaataggtcatgatccaataacgcaatctggtaagtttggtgccgatcgaccggctgaccatttacgagcaatccgtgttgctctgcttcccatgcaaggccctggtactgaatataaccgaagacctgaccacgaaatcccattcctttaattggaaacttattcaaaaacggccggactaactccatctcataaaccaaacgccacaacgcctcgccacttagcgttactcgaataacatgcatcgcgtgtggcaacatggtatgcaaatcattttggttgacgatgcccgcgggaagatcccgcatgaataagccgccattcaacatacccaagtcggttttggcgtaatccgtaatagccgctagtcccaaggccgtcaaatcactggcatggtgccaatgcggccgcagttgctgcggcaccttggcgacaacttgctgggtgagtaatgtttcaccctgttgtttccaaccggcaatcaacgcttcatcaccggtcacgattggcaaactggccgtcgcaacggtatgggccacaaccgtcttaacatgatgctgaccgtcaatcgtcagttcaatttgaccaatgtactcgccatacttaccagctgccgcaatcaggacaccgtttttcagctcgccattcaccagtagatggtgcgtatgactgccaataacgacatcgattaccggaaactgtttggccaaccaccgatcgacattgataccaaggtgggacatcacgattaacacgtcatactgaccggcgtactggcgcaataattctggtagtcgcgtcttgacgctggctggtgtccagccgttcaacgggtaggtcaacgtgaatggcgccgtgaatgccagcaataagatgcgcgtcccccgcgcagtcgtgatgatcttggccggtaacgcccaccgcggcggcaaatgcgtcgccgtatccgtcaaattgtcgagaatgacatcaaaattagctcgatcatacaactgatttaaggcgccgtgcgttaaacccaagccttcattgttgccaatcgtgaccgcatcgtaaccgattccgttcagcagggcaacattggcctgcccctgagtggcttctgagagtgggtgggcccgatcaaccgcgtcgccgagatcgacggtgatcacatggcttccggattgccgacgctgctcacgttcggtcaacaaataccgttggatacgtggccaattttcaaaatgcgaatgaatatcattggtatgcagaatcgtgacttgttcgtccacggttaatcgcccctcaatcgttgtctttgttaatcctaaagcattcaccaaagtcggtcaagcactcacttactggcgcttggcaaaatcgatagctttgccgtcaaccatctgctcgatctcggccagtgaaaatggtgttccaaacggcacagaatggtctaaatagtcgacttctggtgtatcgacacccacattgatgttttccttgacgttgactgcgtagtgatgaatatgcccgtgcagattaataatttgtttgacgattcccatcatcatcggatagtgcgtcatataatattggcggtggtcatacttaatcagcaccccgacgtcgtgaaactcaaacttcggctgaccattcaactggggatcatgagcggctaaatacttaaagaaagcccgcgagtcatggttgcccttgataaaaacgattttgccattcagttgtgccaataacgcaaaaacgcgctcataagacagtttcgctggccgcgtaaagtacagcgccacgtcacccaagtgatagaccgtatcctgatccgtcacacgggcattccaatggtcaataatcgtttgattcattgtctccacatctggaaacggccggggcgcaaagtcgttgtcccccaacaaatcagcatgataaaaatgtgtatcagacgtaaagtattgcattatttaaacctcttattcgtatatttacatttataacatccgccagacgtaacgagcctagcaaactgtcgtgagttatgatcaacctgatgaattttcgttcgtcgacgtgcattcgtccatgttaaccatccgaatcacggtccaactgcaggtcagcatttgacacacgaacccagcaagttgataccaagcgcaactttccagcgagtcaaagttggtggctgtcgaacttattaagccatcgattttaatcatgcatcatacgagaaacaattcgtacaacgcgttagtcatttattattgtaccgcgcaccgtactaaaaggcactagaacagttttaggcccgtgcttcgtcatcgctgaaactggagaaccagtgtcccccgcaagtcctatctgagtagcccaaaagtgcgcctaactgcgatggcagtcaggcgcacttcagtaataatagacttgataaccaacccgaactcctgatgcgggctaactagccatgagtccattggcgaacccggtcactgacaatcttgacggcgtataaaccaaccacccagaccgctgatacaagtagtgcgatcaacgtttcaaatttcaggcatagcaccacggcgatgaacgctaggaacactagaataaagtaatcagataacggaaatagtggcatccgaaatttcactttagctcgactacccgcttgacgccgatacttgatatgtgcaacaacgatggcgccccaaataaagataaagcacgtggtcgatacacttgcaatcagtgagaagactttcccgggcatcagcagattcaagatgaccgacaatccaatcaccagcgtcgagaaccacaaggcattgcgcggaacttgccgtgttgatagtgtccccatccgtttggcaaacttgctcttgccatcatacgttaatgagaacaacatccgaccggtactaaataaggcactattacaactggaagccgcagccgtcagcaccacaaagttgataattgcggcggcagagcgaattcctaagttggtgaagacttgtacgaacgggctgtgtgccgccgaaaagtattgccacgggtacatgcacatcaagaagaatagtgatccgacgtaaaataaaataatccgaactggaatatcgttgattgctttgggaatcaccgtcttcggatcggcagtctcagaagccgtcatgccgaccatttcaatgccgataaaactgaataggaccatctgaaaagaaagcactaaacctttgatcccgtggggcataaagccgccgtaactcaccaaatttgtcaggctggcatgaccgacaggggtcttaacactaaataagaccatgccgatgccgactgcaattaatgctaaaatagctgcaattttaataattgcaaaccaaaattcggtttcaccgaacgccgagacattaattgaattcaagcccagtaataaaattaagatgactagtccaggaagccattgtggtagcttgggccaccaaaactgcatgtattcaccagcagccgttatttcggccatcgcaatcgtaatccagcagacccaatacgtccatccggccacaaaaccggtcttatcacctaagtattgcttaataaaatcgatatatgaatgagtgtggaggtcagataatagtagttcacctaacgcccgcattaataaaaagcacactaacccggtcaccaagtacgcgatcagaatcgccggcccagctaagtggatagattgaccggctcccaagaacagtccggtcccaatcgtgccgccaatggcaattaattgcacatggcggctttttaagcctcgcgaaagttgttccgtcgcaggctgtgaattttctttcgtcattatctttgcactcctcttgaaatcattatagcgggcaagttcccggcattcaaaaggctgcgctctcgaaaattgcaaaattgggctataccattatttgttaagagaatgcaactgatgtgcgcgtaagcgttcgcttgcctacattgacgggattcaactttgtaagttgactaatcaagtggccattgatgagacgtgaataaagtgaaggcaacgcatattagcatgaataactttcactttgatgtctaaaaaagcacccggactttcatccgcgtgccttcttagaactttataatgatatggagattgaatgacttactgactggcggccacgcgttcaacatcccgcgcaatcatgagttcctcatcagtcggaatgagtagcgtccgaatctttgcatccgtcgtactcaagtcccgttcaaccccactgacctgattcttattcgggtcgattgcgaccccaaagtaggtcaaccgatccgcgatccgttgtcgcatacgcgcatcccgttcaccgattccagccgtaatcactaaggcgtccgcgccttgtagctcagctagataggcacccacatacttaacaattcgattcacaaaaatatcgattgctaactgtgcctgtgggtcctcatcacaacgcgcctccagttcctgcatatccgcagagccagctaggcccaggaggccagactgtgtattcaaaatcgcgagcatctcatctgggtcactgatattgagctttttcatgagatagaccaccagtgatgggtccacatcacctgagcgcgttgccatcgtaatcccggctaacggcgtgaagcccatcgaggtatctagtgactggccatggtcaatcgccgtgattgaactgcctgcacctaaatgcagcgtaattaacttcaacgcattaagggggcgattcaataacttcgccgcccgcgccgcaacgtagcgatggctggttccgtgagcgccaaacttgcgtgcaccataccgttgatagtactcatacggcaacgagtaaagatagttcactgccggcatgctggcatggaacgccgtatcaaagacagcgacagcgggcacatgtggtagcacccgcttaaaagcgcggatgccaaccgcgttggccggattatgcaatggtgcatattcggccagatccgtaatctgtttaagcacctggtccgtaatcagaaccgaatcatggaactgctcgccaccggcaacgacccggtgaccgaccccagtaatttcatcatatgagtcaataattcgcaatttgattaactcatccaagacaatattcacggcggttaaatggtccgcgacgatcgccgtctcctgataaagatgatcaacaccatagcgaatattgaccggggaggttttgaacccgattcgttcaacagccccctgtgcaattacccgttcctgtggcatttcaaataacttaaatttcaacgtcgaacttccggcgttgatggcaatggtcttccccaaacgacacactcctagcgaataatattctggtcgacccacgcatcgatttgagccgtaaatgcttgaaaagcacgttggtcctcaaatgatgggaagtcgcctagtaatactttacccgcttgctgggcctgttgtccatgtttctgtaaaacaacaattgattttcgtgatttttcatcaaggaaaaggttcgttggcaagttcaacagaccttgaagataggccgcagtgctcatccattttaagagcccttgcgattcctgtgactgaaaaatcgttgttggaacgaggaaaacgccccaaccaccaggtaatagatgcgccattgcttgttccatcatcagatgatgaacataagaatgaccgttcgtcgccttagtttggaaactttggacacggtcatctaatgggtaataccctactggcaaatcaccaattgcaacggtcgtcttcggcattactagtggatcaattgcatcttgatggaacaactctaccgctgaacgctgtaggtccatgctcatggcggcaattgctaactgattatcgtcattatcgaccccgtagccttgaatcgaatgtgggcgatccgtttgcagctgattcatgaccgtggtcaataaatttccagttccgacggcaatgtccaagatcgacaaatctgtcgtaggaccaactaacttagcaattaaataggctgttaacaggccaatcgagtctggtgtcatttgatgatttggatccacacgatcattatgaatcgcctttaataaggctagttgaagcgcacggcgaatcgtttcggcgtccaattgttttaagtcgatcgtttgatagagctttgttaacgccgccgtctgctccggattcggctttccatcctcaacgtgcacggattggctcaataaattatcaccagtctcaatgagtgcgtctacgtatgaaacggatagttgttgcatcaaaacttgaactgattgatctaagacctgaaaaagcgtctcggtttctgcttgtgccagaatactcaccctcccgcaaaatctgtaatccttaaccatattactgattttacggattaagttcaagtcacggggttcgcgcccccatcaccgggaaaaattatgctgataaggatgctcataggattgcaaaattaggcgatatagcgtctgccgagactgaaaattaacgtatcgttgcgattcgaacgccccgccaatcaacaataagctaatcaccgagagcagaatcgttccgcgtcgcttcttcatccatcgctcccctccgatccggcaaaagtaattgggcctgaaaatgaatgcccttgtcagtcgtcatcgtcagggtcaaatcatcgtcaacgtgaaattgacgaacgcctctaattagctggatttcgccaccaccatagtgatgcaacgcaattcgatgaaggatatggtaatacgtcaataaatactgtttacccgtgaccgtattcactaaatgaactgccttccccggcgtcaggccaccttcatctgaaatatgcgctaccacaaaatgatgatccggattctcaagctcgtggagcatcaaataccattccactgtcggtaaatccacttgggtgcgccgaaccaaattacgctgaccctgaaagagcgtcgtcatcaccacgcccatgattgctaacgccacaacggcttcgattaacgtaaaaccgcgccgcctaatcatgcgctggctccggtgctccggatagtaacagctcgcgttgccggtcttcatattgcttcctagctgtctgaatcgcccgcaaggtctgacgttcgtgtgactgcatcatgatctccaagctttcaaacccaatcagaccacccatcaacaaccccagggcggtgattgtttcaatcatcaagaaacccattcgcgtctttaacatgtgtgactttataggccccccaccccattaaagcattcagtttgattttacgttttggctgtaattgcgatttaaaaacaactaccgctagctctggatgcccatttttctgaatctgaatatcacgcccacgctccgtttttaacgttgctggtaagggcagatgccactgtggtccggtgatgggccgaccacgcttgccaccccaagtcacgacttccgtgccacgaaaactcacgacctgggggtgacccgttacactggcggttaaggtctgctgctgccacatcgtttgtaactcacgccaaaacgcctgttccgcgttctgttgtcgttgacgcgtgggaaatcgatgcacggcaattaccgccatactagctacgattgccaagactgttaccgtttcgattagggtaaatccccgccgcttaaccaccaactacattttggggttgcggccgtactggactaatcccctgggccgtcgcctgcttgtactgtccttcgttgatgtatcccttatcacgaagttcagttaacattttggcatcatccgtaactgtcgcacccgtatcgttcgcatacatctcagcttggttttgaacgacctcagtaagtgcttcttgttggcgaccggccgcctgtttacgttgttggttcaaattgggcaccacaatcaacatcaaaagactgatgattgctaatacgatcaccatttcgatcaaggtaaaaccgcgccgtggtaccgtcgtttttttcatcaagcgtttcattaataatgtcattttaaaatctcccccattgattgatacatcggtaataataggctcaagtacgtgccaacaacaacaagtgcaataatgccaaacatgactggttgaatccaaccaatcatccggttcaattgccgaatcaagcgttcgtactgcaacgttgcaaagtatagtaattcttgactcaactgttccgccgggctctccttaccgactaatagtgctaattcatcgggtaataaacgatcgccttggataatcgtgaccaacgaagctcccgtcaacaacgcccgctcgatgacctgtccttgttggtaaatcagcgccttagtttggaaatgctgactgacttcgcaaataccccgaatccctaaaccacccgtcaataacatcgccgcgttcaggcttaaataatacccacaatagtttctgatcagtggcccaatcaccgggactttggctaaccactgatagcgctgacggctaggtagccggctgactcggaggccaaccagtagtaagcaaatcaataagatgattgccgcgataccactgaaccattgccacctcgcgattaccccactaccattgctgccatgagccaaactcggtaaaatcgccgccttgaccgtccctaaagttcctagtaagagggctatcagcagacacgggtactgtaacaaccgtcgaatttggcgtccctgttccgcacgcgcccgcatcaattggccagcctgtgtcaaggtccttcgtaattcaccgtgagtctctgcaatcaaaaattggtaatacaagtctaccgcaatgtatgggcgcaacgccgtagacaaatcatcgcccgcagctaagcgccccaatgcaggttgcaaggattgaaatgccggaccttccacatccaatgcaaactgaaaggcttgttgaaatgagaagccgttgcctagcaagtccgccagcgtttcaaacagcttcgcctgcattgcaatcgaaaggcgcttacgcttccttaagttgattggccgtcgcataatcaagacggcccgctgccaattgttcatcaattaactccgcccacctttcagtcatcatctgtgacgttttaggcatagtatgcggtaagacgaccgtatcaaaaattgtcgccacactgccatccgtcactggaactaagcgctgataagacaacgccgttaacgcctgttctaaaacggcagcttccacccccaattgtgtcaaccggggaataatcccatagaccccccgcgcatgaatggtgctcaaaactaagtgaccacttagcgcagcctgtaccgcaatccgggccgtttcagcatcacgaatctcgccgatgataaagacgtctggatgatggcgtaatccgactttcaacagatccccatacgccatctgagccggcgcattgacttgaagttgtaaaaattgcggctcatagatttccacgggatcttcgattgtcatgactaatcgctgaccacgaagttgccgcacaaggtcgtacatcgtggaagttttgccagaacccatcggccccgagaataagatcaaccctgttcgccccattagttgactcaactgttggcgttgctggggcactaaatagctcagtttttgggctgtaccttcatacaataagcgaacgaccagcgactcacgatccaggaagtccccaaccgcggagattcgcaagttcaaggtttgttctgacagtgttaacgtcatcgcccctaactgtggccgccgatgatcactgatcgccatgttactccggtatttgatgtgattcattagttgctgcgctaactcagtcgtaatctgagtaagtgctcgtagactgccggctgcttgtactaatacctgatacccttctgccgtgggtaaccaataaatatcactggctcgctgatccacggctgcctgaatgatttcgttcaactctgcttcaatcaccatttatcataatcacgctcctttcaataattagtttcgtaaccacggccactttccacgaaaaaaatgacatttattttggcatcaaaaaagctgtctggaaatatcctattatttccagaacagctcatcatcttatattttgatttatgaccctcaaccccggtccacacttgccatcacgcctaagcaagcatcccagtatgagccaattaggcccgctcagccgcttcaatggcttccttagttggaatcgatggttgcgcacccaatttttgaacagctatcgaagatgcccggttggcaaaccgtaccgcagcggccaaattactaaagtctggcattaagaccgaactgagtgcaccaataaaggtgtccccagctgcagtcgtgtcaacggcctcaaccttataagctgggacgaagccgtgctcagcaccgcgcatccagaaagcgcctttactcccaacggtaatgatcacgttagcaacgcccagcgcttgcaacttctgtgcgccctgaatcatcgattgctcatcagtaatgtgcacgccagtcaaggtttccgtctcagtttcgttaggaacaattaagtcggtcgtcgctagtaattctgcgggcaccgtcgtcgtagctggtgccgggtttaaaatcgttttttgcccagcggcctgagccaattcaaaccctcgaatcgtggctgcaatcggcgtttcaaactgtgcaatcaaaaaagtactggcgctaattgcgggttgggcccgttcgacatcttcggccgtaacctgctgattagttccaccatcgattaagatacggttctcactactactatctaacaagatgaaagctgagccggtactagccacattgctatgttgaacatattggtcattaacaccactattcgtcaactgctgcaccataaaggccccttcctgatcagtaccaactttaccgataaaagtcgtttgggcaccagcgcgcgcggctgcgatagcttggttagcccctttacccccaccagcgacactcttaccagtcaacggtagtgtttcaccaggcttaggaaaacgcttgaaacgtaagatcgtatcaacattcaaactacctagtacggttactttattcatgattattcgtcccttcagtattcaactgctctaattttagcaaactgacctgttagacgcactcgttttaccaatattttaagcaataaaaaacgtggttcttgatttatcatcaaagaaccacgtcttttcatcattaatctgggtagttagcagcttcgtatacttctgatacgtcgtcgttatcttccaattcatcaatcatgtgttgtaacttttccactttatcagcaggaacgtccgttaggttttcaggaatcatggttaattcagctgtttccaacttgtaaccattagcttcgagtgcgtcacgaacagcggctaattgtttaggatcagtgtaaatttcaaacgcttcgtcgcttgattgtaaatcatcgccaccagcatctaaaacgtccatcaacatcgtatcttcgtcagtatctaaatcttcgcgactaatcacgatgtaacccttacgatcaaacatgtaactaaccgcaccagttgcggctaaagccccaccatgatgcgtgaacgctgaacgaaccgccgcagcagtccggtttttgttatcagttaatgcgtgaaccagaacggcgataccaccagggccgtagccttcgtaagtaacttcttcgtagttctccgcaccggagccactacctttatcaaccgcccgtttaatattatctttaggcatgttggcagctttggccttatccataactaaccgcaattgcgcgttagaatctggatcaggacccccggcttttacagccatataaagttcacgggaaatcttttgaaagactttcccacgtttagcatcttgggcgttcttacgtccttgaatgttatgccattttgaatgtcctgacatgtgtgactccttctttcatatttattttcagtttagtagataaacatacgtaaagtatgatagcaaaaaaagcgagcgatttcaagcactagaaccaagggtatccaagttctgcggtttttattgtagcgctaatggcccattttcgtcattgcgcccactttcagatttgaaatctcagttcgtagctgacaaccatgaccacgataatctgctgttacggccgtaaatacgcgtaacccacggcttgcaagtcaacgattcgcaccacaccagcgggaaccaccgtcacgtgggcgggaagttgggccgcagtcatttgatgactcgccatggcattatggcacgcatcaatttcaacttgcggtaacgtctgttgtagtggctcccaggccccagttgttagcgtcgtgatagctggtccgttgaccacgaccaccaccgtactagttggccgtactgccaaaaaattctgcacattactgatggccgttgcgaccttagctggctcatcgacatgcaccactaagttagtcatttgcttggcctccctcgatcgaccgtaactcaattgcacggagatagtgataactactcaacatgttaacgcaggtcgcatccgtttcatccggtacttcataaatcatggtagcgtgcggattaagaactggtaacacccgttgccaatcgatcaacccctgccctaaaggcaagctatcatgctgcttccccatcgaatcgactagatgataatgctgaatgagcggtgccagccgtttcaacgccaacatggtcaattccatatcgccgtgcagcgcaatgaagacgtggcttaaatcacaaaccagcggataatgatgctgaatgatacgctcatctaactgtggatcaccatacatataactggccgttacgccattttcaatcatgacatgtccattcgcctgacgaaccaagtcatccaaccgctcaaagacaatgtcacgggcgacctgcaacgactcatactcatcgatcaagcgcccactgtcactgccgtagccaccgtgcacgagcactttgacatccaattctgtcgctaacgcaagtaactgggccgtactcgtttgtaggaattggtacgccgcagcttcacgatgcggatcgagcaattgatcaagatgaacaccttgataactcatggggtgatgaatcacaatttgctcggtaacattcgtctttacaaattggacggccgttttaagcgcttgaaacgcggctggttcgaagtcagccgcactggtaaagaactcaaatacctcgggttgatattgcaaacgatccattaattgtgcgggcgcctgagacgccttcaagcctaacttgatttttccgggccgcggccgcattactagttgtgtcatccgtttaactcatcctttcacgcattccaaaaccaaaaaggcttggaataaatattccaaacctagtataacgctatcgttctaaattatgccaatgtcactagctggcagacagccgaacctaatcagcagacttggttgagccgcgccgaacaatgccgtatggcaaggtgaccgtcttctcgtcaagttctttatcgttcatcaacttagttaacatccgcatggcaaccgcaccaatatcatataatggttgggtaatcgaggtaatggctggacgcgtgatttgggtgatgatcgtatcattactcgtcacaacttccaagtcatctggaacgttgatcccggattccatacttgcgttgataagaccagccgccatttcgtcgtccccaacgaataccgcagtagcgccactatccgcaatgactggttgtaacttccgcccagcatcatatgagtagcccgcttcataaacgagggcgtcgtcaaacggaatcttagccttggttaaggcccgtttgtaacccgtcagtcggtattcagcgttgattgattgtgacaatgagcctaaagccaacgcgatcttcttgtgaccacgggcaattaagttagtgaccacttcttcaacagctgcagcgtagtcgatattaacgcttggcgtttcattgttcggatcaaccgtcccagctaaaaccactggtgccttggcccgtttgaattcagcccggagcttatcatcaatatggttacccataaagatgaccccgtcaacttgcttagccatcaacgtattcaacacgttgacttcttgttcacccgcatcatcggagttcgttaaaatgatattgtacttgtacatcatcgcaatatcatcaatcccgcgtgctaacgccgcaaagtaaatgttggtcacgtctgggatgattaccccgaccgtagttgaacgcttacttgctaaccctcgtgcaactgcgttaggccggtaatctaaccgttcgatgacagctagtacctttttacgcgttgcgggtttaacgttgggattaccattgacgactcgtgaaactgtggccattgaaaccgccgcttcgcgtgccacatcataaattgttactgtttgtttttccatataaaaatagccctttcttgcttggtatcatatgttttcattcgttttcatgcaacatcaaccaatatagcaaaattacgcttccaatgcaacttaagattgctattgaaatcgctttcatgaaaataataccctacttgttttcaaaatgcaagatttaccacacgaagattgttagtttgggctcattattctcagctttttatcatcaacagcgctatactagtattattatctattattttatctaaggagtgtttgaattgacagattatacgaaactgcaacaagtccgtcaatggacccaagacaatcacgttgacgtgacctacatcagtaactttcacacaatttcatatttgactggttttgagagcaacccctacgaacggacgctagcactgtttgttttcgcggatgcggaaccatttctctttgcacccgctctcgaagttgaagcaatcaaggagatgggctggccttacaaagttttcggctacctcgaccatgaagatccatacgcgctaattgctgaccacattcgcgcccaattgactgatcctaaggtttgggcccttgaaacgggtaacttgacgttagaccgctttaccgccctcaaacagcaattcccagcggcccacttcgataaggatctatcaccttatattcaacaattacggttagtcaaaacagccgacgaacttgaaaaactaaacattgccggtaaatgggctgattttgcttttgaacaaggatttgccgctgtcaaggccggtcgtactgaacagcagattgccgccgaattacagtatgccttaatgaaaaagggtatcatggaaatgagcttcgacactttggtccaagctggcgaacatgctgccaacccccatggtgcgactaacgaaactcaggtcaagccaaacgaattagtcttattcgacctcggcgtcatgtatgaaggctatgcttctgatgcttcgcggacaattgcgtacggccaaccgagcgctaagcaaaaggaaatctttgatgtctgtcttgaagccaacttaactgctcaagcggccatcaagcccggcatggctgctgaagatgtcgataaaattgcgcgcgatatcatcacaaaagccggctatggcgactacttcattcaccggttaggccacggaatcggccaaactgaccacgaatttccttcaatcatggctggtaaccacatgccactcgttgaaggcatgtgtttctcagtagaacctgggatctacattccaggcgtcgctggtgttcggatcgaagactgtggggttgttacgaaggacggctttaagccatttacccacacgccaaaagaattgaaagtattagacctttaattaacaatgtcaaagagggccgtcacggctgatatcgtgatggccctctttggtatgcattctaataccgtactattccggtaacgggtgttcggcttcataatcagccacttcggctaacagcgccgtcgtcgtttttagtggtagcacgtcacagtcaaccgcagcttcactccctgcctgactcgcacgccgataaacatcaatcttatgattgactttttgcaaattcaataaggattggtggatttgtgcttcaacggcctggcgttgttcttcaaacattgcaagccgttgatcaatcgtttcatccccatcggcacaccagctaataaattggcgaatatcttctaacggcatcccggtctgcttaagacaacgaatcaatgccagtgaatctaagtcttcatcattaaagactcggcggccctgcttatcacgcttcacaaagggcgttaaacccgccttatcatagtagcgcagtgtataacttgaaataccggtctttttagcgaccgctccgattgaatacaatgtgattcctcctcaaaagcagataggacaccgagcacttgctcagtgtcctatcttatcgctgtcagcttacttggctggtgacgattcatccgtcgtcgattcatcatcagacttcgcagctgttgtatccttagcagttgctgattctgatgttggcgctgaagtctccgcttcctcgccggctttttgataagcggccccaccatcaatgacgatatcttcatcgtcaccttcatcatcttcgaccttcgctaactcagaccgtaaactatccgtagcttggtcaaggcttgagccaaagctttcgcccgtttcctgcttagctgcttggtactggtcagcaaaatcggccactttctgcttagtatcttcgaattgttgaccggcctcagctttgaagtcttcagctgcatcattagcatagaacgcataatcgatggcccgatccttgaaatcggcaattccttgttgggctttagcttttaattcagcttttttcccatcatccattttcataacggcggtggcaattgctgcgccacctaagacaacacctaataagaatccttttttcgacataattaagactcctcactattattttttgaacgccggttgcgataaacatcaaaagccgctttaccgaccttgcttgcgctggagaacttgctccgcttctcattgttcttgccaatcttggccgttaagtcccgagttgcggcattcaagtcagaaacactctgacctaagtcacccatcgcttgaaatgctgggtcgatcgttgcaactttaccattgacatcctttaagagctcgttggcatttgccatgattttttcagtttcatgtgacaaggcgtcaacgtcatccgtaatattatttaaactacggttgacttcccccattgttttagtaatccgcattaagaaaatcccgataaagcataccaataataagaatgcgatggcggcaataatgcccgcaatgtgtgtaatcatcctaaaattcctccttcaacagccactatattagaactagcatagcattgtctttagtataccgcaattaaaaaagtgcttacaacattcacccagccacatttggttgcaataacttgctcacgacttggttgcccgcgtcaaatctgataaactagtgaacagacaacaataacgagggtgaagatatgtttaattcaattaacctagcagcggtcgacacaccgactaaacaagtttcggtgtggatgaagttagctaagaaaattgactggcaacaaattattattaatattggcggcaagctactcgaaatcattttatttattttactattttgggtgatcgatcggctaggaaaacgcctgatccaccacttgtttttaacgaatgcgaatactagtgatactgccaataatcggatttcaacgatttttacattatcattaaatatctaccattacgtcattatgttttttggcatctatgcggtcctttcagtgttaggtgttcctgtggggacgttgattgccagtgctgggattttcagtgtggcgttaggtttaggcgcccaaggcttcgtcagtgacattgtcaccgggtttttcattctacttgaagatcagattgatgttggggattacgtcaaaatcgaaaccattgaggggaccgtctccgcaatcggtttacggacaactcaagttacgagtcccgatggcacgttaaactttattcccaatcgcaagattttaatcattagcaaccagtcgcgtaacgatatgcgtgtgctgattgacctctacattctcacaacgacgcccgttcaagaactgactactgtggtccgtgaaaccaatgccgacctcgtgcctcagtatcctgatatcatcggcgaacccgacattcaaggcgtcacgacccaagccgatgggacgttggtcttccgggtccaattttacgtcaaaaatggtatgcagttcgcaattcagcgcgactttttggccgcctacttggacgcggcccgagcagcgggaattcaactcccctcgccacgtttaaatatcgccccaacgcacaagtaagctcaaccaatacaagcccgcacggcagttactcagaaatgagcactgctgtacgggcctttttgtccacattttctgtgtgggccatgacataagtggctaatgacaaccgtggtcaccaccgtacggcagcaactgacttttgatactctgggtaggcggggtcacaaactagtgtgggtgcgaatcatagtcgcaatcggcgccatgatccggcggccacgacgtaaaaaaaacgtactggctaagtatgttggcacagtacgttttgaaaattagttacgtaacgcattccgatgagtcaaaaagccggtcatcgcattgaccccactcataatggcggccgtgtgtggcaccatattttctgaatgtagtgaatatggactgtcgacccctaaccagaacatcgtccctggaatctgatgaatcaaataaccaaagtcttccccagtcattgctggttccgtttcgatgaaattgacatcatcatcatcctgcatgtacttgataaaatcagcagtgattgcatcattgttctcaacgggatagtaaccaccctgattgagcttcaaatcaatattgcagtcataagcgagcgcaatcccctcagtaatcgtccgaacccgccgctgaatatgcatgttcatctcctgcgtcaacgctcggatcgtcccgtcaatctgggcctcaccggcaatcacattgccaatcgtgccagcagtaaagtgacctaatgtcaccacaccactttgaatcgggtccacgttgcgcgctacgatcgtctgcagctgggagactaacgccgcaccagcgacgaccatgtcgtttgcttggtgtgggtaagccgcgtgtccacttttaccacttaagtgtgcgtgaatctcacaagttcccgcaaataacgtgcccatccggcaaccgattgcgccagttggtaaattaggattgtcatggaatgcaaaaatctcatctggcatccaatcaccatctagcgcaccactttcgtacaagcgttgcccacccgaggcattttcctcagccggctggaacatgaaaaccatgtcggtcgcaggtcggttctctgcaaagtagctcaggattcccagtgcaactgacatatgaatatcatgaccacacgcgtgcatgacacccggatgggtcgatgcaaatggtaagcccgtattttcagttactggcaacgcatcgatgtcagttcgataaccgattcgataatcatgctttaaaccactgactttcaccaaaatcgccgtatccaaagttggaatggttttgattgtcagccaatcttgaggcatcttgccgataatcgacaataaataggcctgtgtctcatgttcttgtaagccgatttccggaatttggtgtaagtgttgataaattggaattagatcggtttcccgtaagaccattgtttatccctccaccattaaagattccgtaattctgccattaattcagtcttgctcttagtcttatcatcaatatctttcaacttacgagcaggaaccccaccgacgacggtgttaggagcgacgtcttcaatgacgattgcaccggcagccacaacggcacctttaccaacatgcacgccttcaagtacggccgcattggcaccaatcagcacgtcgtcatcgatttgaactggtttagccgaaggtggctctaccacgccagctaacacagtaccagcgccaatatgacagttcttaccaacgattgcacgaccaccaagaatggcgcccatgtcgatcatcgatccctcaccgatttcggcaccaatgttaatcaccgcacccatcatgataacggcattatcgccaatcaagacttggtcacgaataatcgcaccgggttcgatccgcgcattgtattgcttcaaatctgccattggtacggctgaattacgcacgtcattttctaattcataatcttcgatatttgcagcgttagcctttaagaacggttcaacatccgcccagtcaccgaataataccccagcgttgccactgaagaaagttttgatgcctgctggaacgtttaattggtctaaagcacccttcacgtatacttttacgggtgttttctttttcgcactgccaatgtagttaataattgattgtgcatctaattttgccatcggagaccctccaaaaatttatttagctttttcgctagtggaaaaatccttctcaatcatatcatattgtttgccaatttcatgagtcagaaagttaaaactcttcatgaattcacgacgagtcacaattccttgaaaaatttgctgttcatcaacgactggaacaaacggattgtcgatcatcaggtgtaacgtctcttcgacatcatcaacatcacgaaccgtcttgacctgtgtctccatcacatcccggacgcatttttgcagtaatatttcagtattcagttgatcaaaacctagcatttgttcagtaatcagtggtaacgacactaaaccttcaaagtgaccaccatgatcaagcaccggaattttggaatacttaaccttggttagtactaaaaacgcgtgatacaaattattatcagtttggacattggcgaccacgtccgccggaatcaaataatggtcggcgttacgtgacaataagtcttcaactggttgaattaacatacagcgcctccttcactaagcccatccttttattttaactgcaaaagcactttgcgtggttctagaaatgagttttttaccacattttaatccgcaaaatgaaattttagttctggcactgcttgtagctgtcggttatagtattgcacgtcaatacccgcggctgacgttgtcacgatggcgtaagtacccccgacacgtgcaaattcaccacgggggtaagtaatgctacctggattaagtacgaccacaccgctccgccgttcgacacccagttgatgggtatgcccaaagaaagccaacgttgcatcgtgggcctccgcgttagccactagatgcccaagtcccaggttcacgcctaccaagtgaccatgtgtcatgtagaccgttaccccttcaacggtggggttaacttcgttcggaatcacggcgtcaaaatccatgtttccttgaaccgtaaacatctcttgaaagattgggtcatcatgcggtaactcagaatcaccacagtgaaaaaaagtgtcgactttgccgcggtactcatggagcaatcgaactaacacatcacggtcaccgtgactatcacttactactaaacatttcatgctttcgcccaccattcgtcgaatttagtcatcagctgtcgcaaggccgcgccccgatggctgatttgatttttttgtgctggcgtcaactctgccaatgatttttgaaacttagttgaccagaataacggatcatagccaaacccattgtcaccacggggggcaatcagaatacggccaactaactcaccattaacaacgagtttttcaccgctgggtttgagggcgaccagggtcgtatgaaaagtcgcggtccgctccgcttccggaacgccacccagattagctaacaacttggcattatttgcagcatcattatggtcaccagcatatcgtgccgaaaacacgcccggatccccgtgcaacgccttgaccatcaagcccgaatcatccgcaatagctggtaacccggttgcttcgaccacaactgtcgcctttttagcggcattttcttcaaacgtaatgccgttttccttgatttcaggaatatcaggaaaatcggccaacgttttgatggtgatgtcatatggtgccaacattgcgctaaactcgcgtgccttattggcattattcgtcgcgatgatcaatgtttgtggtttagtcattcgtttcactccctaagtcaatatgttgtgcgtgaaagtccggttgatccaaccagttacgcgcgatcgcttcgaattgatcagccgcgcccgttgtatagtactcgtccggataacgcttagtagaacgatcattagcgatatccaagtaatcgagtaccgcagagacatcattgatcgtttcagccccagaatcaatcaaggtcaccccgggtcccatcacattttgaatgagtggccgcaataatggatagtgcgtgcagcctaagacaagcgtatcgacatcttgtttttttagttgcttcaacgattccgcaaccacccgcttggcaaccgtcgattgatactcattcgattctactaacggtacaaacttagggcacgcctgcgaaatgaccgtggcagtgggatccttggttaagatggcatcccgataagcattgctacgaatcgtcccctcagtcgcaatcacaccgattcgattacgatgagaagcttttaacgcggcccgcgagccgggtgcaatcaccccaataaccggaatcgacaactgctgccgcaacgctggcaatgccgctgccgtcgcggtattacaagctatcacgagcattttgatctgctttgccattaaaaaatccgccatctgaaacgaaaaagttcgcacttgttcagctggtcgcggaccatatggcaaacgcgcctgatcaccaataaaataaaccgtttcgcgggggagttgcttcaaagcttgcttgacgacggtcaacccgccgacccccgaatccatgaatccaattgcatgttcatttgccattttaaaaatctccgttcactgaattctgaaactttattatggtcttttttgaaattgatttcaagccagaccaattgcgacgaaattgtaaagtttccgttgataaattgaaaaaaaccgacacattggtggaaacggggtataataatgattatacagtggccagaataccacgattttttgcatggaaaggaattatcatgacgaacgacttttattctcaatttgcgggcaactcgatcaaagcttccatcctcagtgtggaaatcttacgagatgccttaataccaaaattattgggtgatgacagtagtggcatcctttactgggcgggtaaagacttggcacgccagtttcctgtcgctagtgatgatgatcttgttaccttttttgagcaagccggctggggacaccttgtcgtgattaatacggcggataatctaatcacgtatgaattggttggtgagccggtcgcgcggcgtagcgccacgatcaaatcacccgactttatgcttgagactggctttctagctgagcagtcagctctccgtaccaactgtgtgagtgaagctaaaatcacgtttcaaaatcgcatgcgtctgcgcatctcagttacgattgatcacaatcaaccaatcgtcaatcacgatcccgcaactccaatcgaaatcgtgcgacctcaagttgaacttgatgacgaacaacctgaagaagcgcagtaaaaaggacggccagctggccgcctttttttcaggccaaaacaccaattgctcctgagaattcgacaattagcagtggtcactgccctccggaacaaaaaaacgcgccgttcacttaagacggcgcgttcgttagcgaaccatcaatcaaatgacggtcagccgattatagatattgagctaaagtttgttggatttgttccttggaatggtagccaactaaggtatcgaccacttcgccatccttcttaactaataaggttggaatgctcatgataccaaaattgctggccgtttcggggttggcgtcgacatccatcttattgaacgtcaccttgtcccccatctcgtcagctaattgttcgaccactggtgactgcatccgacaagggccacaccatgttgcccagaagtcagttaacgttactcctgaagccgtatccgttgtaaaagttttatcagtagttgctgcgaccattataatcggcctcctttaggctttatctgttactaatagtaagtataccagtaaccgggtggaacacaaacaatttgcctgcaattaaagcgctggaatcgtgtacagccatgaatgcgcgtcatcactgatctgcacctggcactcgtctttggttatttaaactgtacctcagtcgcaccattgccgccatgatttggcgcagcaaagtgaaacgacttgacttgccgattagacttgagatagttggtaatgccttctcgtagagcaccagttcccttcccgtgtacgattgtgacggaaggatacccggccaacaacgcagcatcaatatagcgatcaacttgagtcatcgcgtcttcataacgcacaccccgcaggtccaagttcggcgaaacgtgactcgcgtgggcactctgaaccgtcgcccgggcccgcttgggctcttctggtttaacccgttccaagtcaccgtcgttgatcttcatcttcaagataccgagttgaacttcccactcgtgtttacccatctgacgcatcaacacaccacgttgaccatacgatttgaccagcacgtcatcaccttcatgaaaatcatgttgggctttggcccgccgtagcacgcggtttttcttgagcttaggctgttgctccaaggcgttcaacgcgcccttggcatcgatcaactcattttctttgacggtcgccgtgccactcgcaagttgcttcttacgcaaatcactaataatggcatcggccttggtcttactctgctcaacgatggtattggcctgcactttggcatcttcgatcaactgatctttacgctgttggtacgcattgaactcactcttcagctgccggtgcaacttctcagaatctgccacttgggttttcaagtgcagttgttcatcttcaacctgtttgcgcttcgtcaccaaatccgcaatcattgcgttgaggtcttgactatccgtatccgtcaacgaccgagcttgatcaacgattgtttgcgggatgcccaaccgctgtgcgatatcgagcgcattacttcgaccaggaatcccgaccaatagccggtacgtcggcttgagtgtttcttcgtcaaactccatactagcattgatcgtatcaggtcggttaaacccatacgccttaagttctgggtagtgagtcgtcgcaacgacttgggttcccttggccccgatagcatccagaattgcgattgccagtgccgcaccttcttgcggatcagtcccggcacccaattcatcaacgagtactaaactgtgagcgtcgatctgcgctaagaaactttcgatattttccatatgggatgagaacgtacttaaattctgttcgatcgactgttcatcaccaatgtctgcgaagatctcattataaacgccaacacgacttccagcttcaacgggaataaataatcctgactgggccatcaattgcagcaagcccaaggtcttcaaggtgatcgtcttcccaccagtgttaggccccgtaatgaccatcgcctggtaatcagtgcctaaactaatatcattggcaacgactttgcgaggatcaatcagggggtggcgtgcttgccgtagatagacttcatttttgggtgaaacggccggttcagtcgccttcatatcatgcgcatagcgcgccttagcattaataaagtcaaaatgcccaagaatcgccgcattattgataatttcgtcctggtaaggcgcaatcaagttggagagctcctccaagatacgctgttcttcttgcttttccgcaacttgattttgccgtaaccggtcattcatcgccatgacggcctggggttcgataaagagcgtctgaccactcgctgattgatcatgcacgatgccaccaaaccgactgcgattctcggccttgaccgggataacgtaacggtcgtttctaatcgtaatgattgggtcgcttaaatacttggcatcatggccacgggtataatgacccatttggttacgaatctccgtttcagtacgacggatattgctccgaatccggctcagttctggtgacgcctcatccgtgatatgaccgtcgccttcaatggcagtagcgaggcgtttcgtcacatctggtaaagtaactaattctgcaacttcatcaaacaggtgccgaatatcattctcaggagcatcttctagtagctcggcaaaaaagcgcgtgatggcgcgtgttgtccggagtacccgcccaacttgcccgagttcactcccattcaacgtcgcaccgatagctaaccgtttcatatgcggttttatatctgctaaacgagcgaccggaatgccaccctttaaccgatacacttcagccccgtcgttggtttcatctaaggcccgttggatatctgcaacggtggtcattgggtgcagttcattgagcgcttgttggcccgttgccgagaccaagtatggtgctaattgttgttttactcgttggtactctaacgtattcaatactttggaattcactgatatccctccgaagttccaatgaattacgaaaagccgcaaaaaaacggacaatgcaattacttgtcggcatcatccgtttgcattttcaataattcagcttgtttgtccacctgatctgaaatcgcattgaatgcgagcaacgtcgcaatctccgtatcagacaaatcgggggctaatttttttaattgtgccacttgctcattcatcatccgcgtcaccgtttgcatgtgacggtcagatgccgtgccaatgatcgtgtaagtacgaccatcaatttccgctttaaagcggcgcttgttagcagtcatcaacatcccgcttcctttcaataacaattaatattctagcatggttatcataattatgcgacagttagaaccgtcccataatttctaaaaaagcccgcggacatgcgcccacgagcttaatctactttcgactattgcatgccaccgtcatcggctaagaaggtattcaaaacttgctcaaccatatcccattcgtcgtccgactcgatcagttgtaattcgccattgtcgccatcttcaggattaaagatgtaggcttgaatatcaacttcatcatcggccgcagcatctgctggatataacagaatgtaagagtgaccgaaatcttccgaatcaaacgtgaataaaatgttaaataaggtttcgttaccttcgtcatcaactaatgtgatcacatcattgtctttacgatcttggttttggctcatgttagttcctcgctattcttgtgtgagtttgccatggcgatccaagtagttttgcaagatcaaacttgcggccaacttgtcgatcacctttttgcgtttctttcgtgaggtgttggcttcttcaaccagcatccgttcagcttcaacggtcgtcagacgttcatcttcaaagtctaccggcagatgaaaccgggctgtcagtaactcgccgtaatgttgtgcggcttcagcccgcggtcccaaggtattattcatattctttggtagccccaggacaaagccccctgcatccaattgctcaacgagttctgcgacccggtcaatgccgaattcctcagcatcctcattgattcgaataatttcaacgccctgcgccgtccatccaaaagcatcgctaatggcaacgccaacagttctggaacccacatctaaccccattaacttcatgcatcaacatccttatctgcctttaagtaagacttgacaagttcttcaataatctcatcgcgctgatgctttcgaatcaagttacgcgcatcctttaagcgcgggatatacgccggatcaccggatagtaagtaacccacgatttggttaatcgggttgtagcccttttcttgtaacgcttcataaactgtcgttaacgtgtcgtggacatccttaacgctgtcattatcgaagtcaaagtacattgttttgtctaatgaactcatatcaagcacctcccgctagtttccgcttcttatctattttactaaatgcccatatgaagtacaatcaatccactttgatgtaacacattcgtaataataacccggagaatgcagacgttttctgcaaatccatcccgatttacactgttttttcatatgctgacatacccctgtttcgaatgttcgaatagttgaagttcaaaacaggcacaccctttgtaacccaatcttctacgagttaagccggtcacaaggtgccataacattaaaaaatcagtaccgttagaacggtctcgtcctaacagcactgatttaattgttattttgatagctttaacatagctaaccaacataaaaaacaggatgtgcaaccaaagcaatcagtcttattgttcggcaagccactcatgcgcagctttcagcgccgctggtagtccagcaggcttcttcccgccagcttgagctaaggttgggcgaccaccgccgccaccaccaacttgtggcgcaatggctttgatcaagtcaccggctttgatgccggccttgactttgtcatcactaaccgcaactaataagttgaccttttcgccaatgaccgttccaagtaccagtacgtcagaatactgcttggtcttccaagtatcggccaattgacggagttgatccatgccagagacttcaatttgttgggcgatcaacgtcgtaccattcacatcgtcaacttgatcaaagacggccccagcctgctgttttgctaagcgactttcaaggctggcccggttctgttgttccgctttgagatcagcttgtaactggctaaccttggctggcgtatcggctaacttcggcgccttgacctgagcagcaatctgcttcaaggtctgctcttcaccggccagcaattcgaaagcttcttttgaagtaacggcttcaatccgccgcgttccggcaccaatccccgtttcggaaacaatcttaaacagccctaattcactactgttcttgacgtgggtcccaccatcaaattcgatcgagtaatcaccaattgaaacgacccgcacaattttgccatacttttcggtgaagaccgcaattgcccccatcttgtgaccagtttcctggtcagtctgaatggcgctaactggtaaagcggcccagatcttatcattgacgatttgttcaactttggctaactcttcgtcagtcacttgaccaaagtgagtaaagtcaaaccgtaaatagtcgggttcgactagtgaaccagcctgcttcgtgtgttcacccaagacgtctcgtaatgcttggtctagcaagtgagtcgccgtatggttcttttcgactttgttgtggaaggccaagtcaacgttcaacgtataggtcgtatctttgtgcatgggtttcaatacttcaacagtgtgtaaatgctgcttgttgggcgcattttgcacgtcagtcactttagctactgtttgaccggcatcatctaagatcacaccacggtcagcgacctgaccacccatttcagcataaaacggtgtcttgctgaaaatcatttcagcttgaccactatcgacgtgatcaaccagggtctcatcgacaataatgtcgttcaaagtcccctgcacatccgttaattcgtcatagcctacgtattcacttggcgttttaatgtcgatcaagagactccgttggacgcccatagacttggcactgctacgtgcattacgtgcacggtcacgttgcgccttcatttcaacttcaaaacctgcttcgtcgacgtctaagtcttcatcgccagcatattccttcgttagttcgaacgggaagccgtaagtgtcatatagcttgaatgcatccttaccagctagcgtatcttgaccagcctgcttagtttccgcaatcaggttattcaacaggttcaaaccatcattcaaggtctcattgaagcggttttcttctgaagccacgattttttcgatatacgcactatttttgagcacgtcaggatagtgtgaagccatgatcttcccaacaatcggtactaattggtccaagaaggcttctttcaaacctaatttttgaccgtgcagaattgcccgccgaatcaaccgccgaatgacatagccacgaccttcgttggaaggtaaggccccgtcactaattgcaaacgtaatggcccgagcgtgatcggcaatcactttgaaggacacgtcatcctgagcattatcaccgtaatgcttgccatcacttaattcttccgtcttatgaataattgggaggaacaaatcagtttcaaaattggttttcgcattttgaaagaccgaaacgacccgttctagccccatccccgtatcaatgttcttacgtgggagtggttcgtaagtaccttcaggagtgtggttaaattgcgaaaagacaatgttccaaacttccaagtaacgttcattttcgccaccaggatagttttcagggtcgtcatcggccaaattgttgaaagcttcgccacggtcatagaagatttctgaatcggggccagatgggccttgaccaatatcccagaaattatcttcaactttaataatgtggtctggtttcacaccagttgcttcccagaatttcgcggcatccgtatccttgggataaacagtcatgtacaacttgtcaggatcccagccaaaccattttggtgaggtcaagagttcccaggcccaactgatggcttcttttttgaaatagtcaccaactgagaaattaccaagcatttcaaacaacgtatggtgccgcgctgtccgcccaacattctcaatatcattcgtccgaatactcttctgtgaactcgtcatacggggattgtccggcacaacggaaccatcaaagtatttcttcatcgttgcaacaccggagttgatccacagtaacgttgggtcatcaacgggaactagtgatgcactagggacaatcgtatggcctttttcatgaaaaaagtccaagtacatttgccgaatttcactactacttaattttttcatttaattctggcaccctctctatcattcttaatttaaggcaaaaaaacaccgttgctagcaaagacgctgttaacgcggtaccactctgcttgcaacgatgtgttcgtttacctcttaagctcattaacgctgagacacggactagtttgctagtcattacttctaggtagcatctacaccacaccgcacttttttcagcaaccaaagcgtttcttgactgatatgtgatataaatatgtccttactttgcaaagtatagaaaacttgcggcgacttgtcaatacaccgctcagttattttgcattaatctatccagatacgcgtcaattaagacttacgatccttacgttccttgcgggcagccgctcgctgttcgatgcgacggtccatccgcgccttatcgctgatctttttacgaatacgacgcttgtaacccggcttgaccttcttcttagacttcttgacgtagccaatcaacgttggatccaacttctcttgtttaggtccccgtttagcccgccgattacggtcatacgaatccacaatctcaccatcgcgaatcgctttcggcttgaacttgatgcccattgcctcaaccgcactgaccttggcttcttcacccgggctatataacgtaatcgcagtccccgccatgccattccgaccggtccggccaacacggtgaatgaagaattccaagtcatttggaatatcatcattgatgacgtgcgaaacaccttcgatatcaatcccccgggctgctaaatcagtggcaacaacaaattgatacttcaactgctgaacgtcacgcatgacccgcttccgttcacgtggttgaatctcaccatgaatcatggcaacggttaacccttgttggcgcaaataatgggtcaactcttgaacacgttccttcgtgttagcaaaaatcaacacgagatacggttcaccaatcgtcaacaagcgataaataatactgttcttgtcgtgactcttagtagaaattagccagttatcaatcgttggactgatcactgattccacgggaatttcttccataactggattattcatatacttgcgcaagaatggcgttaatttttgtggcatcgtggctgagaacaccagcatctgcaaatcagccggcatccggccagcaatctgatcaaccacgttcaaaaaacctaagtctaacgtcatatcagcttcatcgaccactagctgagtcgcacgatgcacatcgagtgcctgggaacgcattaagtctaaaatccgtccaggggtcccgataatcaactgaggttggtgccgatttagcttttcaatctgttcctgcttatcagttccaccgacatagagtccaatgtgaatggctttcgggctgtgttggatcaactgtttagcagcagtctgaatctgataagctaattcacggctgggcgttgtgataactgcctggacgtatcgttcatcagcattcagttggttgatcatgggcagtaagaacgtatgtgtcttaccactcccagttgctgactgtccaataacactgcggccagcggcaatcactggaatcagcttttcttgtactgcagtcggtttgcggaaattgatgtcagtcagtgcctgcatcaagaacggctgcaatttaaaatcttcaaaacttgcggtcatatttaaacctctttctcataatggctagcgacttggtcgagttctcgcactaccgtttcaatttcttgttggtctttagccttggcaccgctcgctaatgcgtggcccccaccatcatggttcttggccacaccgttgattgacggtccctttgaacgtaaccgaatacggaagtcaccttccttttgttgaacaaaaatcgcccagcacttaaccgtatcaatacgcccaggtaatgggacaaccccagcagtactagcatcaccgattgcaaatgaatcgagaatcgcattcgttaaaataacgtaagctgcacccgaatccaactgtgtcagatgttcataaacgtaggccgacaaccgtgcgactggtaacgtgatggtatcttcaatacgattgacagcttcagcatccgcaccggcttccattaaggccgctgctgctcgcatggtactaggcttggtcgcagagtatagaaagcgaccggtgtccccaacgatgccggcatacaacaaccgagcggcgttagccgttagcgttaactccgccgcaaggggtgcgtaccaattataaatcatctcactcgtactggaagcatcaacgtcgacccactgtgggtcaccgaaagcgtcatcgtttgggtgatgatcgattttaacaattgtcttaccttgattccaaagttcaccatcaattcggggctgattagcggtatcaagaattaatactagtgcgtcttgatagtccgcttcggtaacctcatccatttgtcctaaccagtcaaaaccatggtactgttttccaggtgtcaatacccgcttcgcaggaaagctagctttaatgatagctgctaaccctaactggcttccgatggcgtctgggtcaggtcgctgatgacgatgaatgatgattgtttttgcttgtttaattaagtcaaaaattgctgtttggacggtcataaatgaaccttcttactctcataatttactggtggcgattaaactgtcacagtactccagtataccgaagaatccgcgtcgcgccaaataaattaattatcatttggataaagtggtaacgttaagttctcaaacgccagtggtgccaagccggttaacgtgattcccagcaagcgaatgccagagtcaaaatggtcatcgaccacctcttcaaagatttcttcggcgtactgctcaaataaggcggcatcattaggtataaattcactgaacgttcgccgcttggtaatcgtgacaaagtccccgtagcgcaacttgagaacgagcgttttaccgtggcgctggtgcgattgcatacttgcttccaccaatttagcgatggccttcaagtgggtattcacttccgtcgtcgattggaggaacggtccgaatgtccgctctttgccgattgacttccgctcacgtaaatactcaaccggccgatcatcgctgccacgcacccgccggtataaaacatagcccaacttaccaaattgtttgatcaagtccaattccgactgtgcgtataaatcttgcccggtcttgatgcctaaatcgtgcatcttcggtaccgtctttttaccgacaccgcgaaatttctcgatgggctcccgcaacaaaaacggttccgcatcctgtggcaagacgatcgtgacgcccgccggtttgcgataatcagacgccagtttcgcaataaacttgttgtaggaaatccctgtcgaacaagttaaatgcgtttgccgccaaatctcctgttgtagtcgatgcgccaattcgaccgcactatgaatgtgttttttattcgtagtcacatccaagtaagcctcatcaaaagcaattggctcaatcatctccgtatattcatgaaagatccggtgaatctgcgccgaaacttcgcgatacaatggaaagttgggggtcttgaacaccgcttttgggcagagttccaatgctttagcggctggcatcgccgagtgaacaccaaactgacgagcaacatagttcgccgtggtcacaacaccccggcccccagtctgccgaggatcatgagcaatcaccaacggctgcgtcttgtacgccgggtgctcccgctcttcgatcgacgcatagaacgcgtccatgtcgacatgaataattttgcgactcgtatctacccgtatgggtgcttcaataatcgactgtgccatgcgtcgaccctccaatccttagtagcttcattatacacgaacgtacgttcaaaagcgcgcttcaagaccaaaaatgagcaaaaaaaataagcggtcatcatcagatcggccacttataattcaaatctattttgcttcagaatcagcattatcatcggcggctgagcttgccgattcaacttcagaagtagcagctgattcagcggctgccccagattctggtgcaactgtcttagcttgtgcgtcttcggctggagaaatcttagcaacagcgttcaaatcaaaaactaagtagatgccatcacagtctaaggtgactgtcttttcggtttcgttaacttcatcaacgaccccgtgcaagcgaccaatcgtcgtaaccttgtcaccacgtttgattttgcttaacatttgttgatgttgttgttgttgtttccgttgtggacggatcatgaagaagtataagaatgcgaacatgaccacgataaacagaattgatgccatttgacccatttaaaatcgctcctactctaattaaaagtttgactatctttaactttaacaaattacggtctgaaataccagtatccctaaaaatttttcgggtttttctcgttaaaaccgtacatttcgaagaagttttgccggaattccagtaaattatcatccataatagcttgccggacttgcttcatcaaatgtaacaagaagtacaagttatggtaactcgtcaaacgtaagccaaacgtctcatccgccttgatcaaatgacgaatataagcacgcgtgaagttccgacaagtgtaacaatcacaattatcatctaacggggtaaagtcatgggcgtaggccgcgttcttaacgactaaacgaccatgcgaggtcatacaagtcccgttacgagcaatccgagtcggcaagacacagtcaaacatatcgaccccgcgaatcgcgccgtcgatcaaggcatccgctgaaccaacccccatcaggtagcgtggcttattttctggtaatagtggcgtcgtgaagtctaaaacatgattcatctcagccttcgattcaccaacagataagcccccaatcgagtagcctgggaagtccaaactcacgagatctttggcactctgttcacgcaaatctttgaagcccgcaccctgaacgattccaaataagccctggtaatcaggatgttgatgaaccttcaagccccgctcagcccagcgacttgtccgggcaactgacttgctaacatagtcgtaactttcaaagaatggcgggcattcatctagactcatcataatatctggaccaaggtcattttcgatttgaatggccttttcaggagataagaacatctttgaaccgttcagatgattcttaaagtggaccccttcttcagtaatatcccgatttttagccagggagaagacctgaaaaccacctgaatccgtcaagattccctttttccaattcataaactgatgtaacccaccagcttctttcacgatttgctcacctggtcgtagccaaagatggtacgtgttcgataagatgaccccggcacccatcgcgtctaattcttcgggtgcaagtgatttaacactagcttgcgtcccaacgggcataaacatcggtgtcgggaaagtcccgtgtggcgtaatcaattcgccaaggcgggcgcccgtgtgtttttctttcttaattaatcggtatttaattgccggttccatatctgttcctccgtattaaaatgttgctaaactcaaataatgatagcacgaaatccggccgtgaaccagtcatggcgattagcgtcacatccaccacttcgatcggtgccttgactcaatcggccgctcgagcacctaaacaacaaatagtcgcttcaagaatgcgtataacttcttgaagcgactattggcaatctttaggatttcaggcgctaaaaggattgctcaaaattggcactatcccaagcgcaagactaggttcaatagtcccacccatttcaagatggaattcctactttagaatccgttaaactagtgaataaacatcgcatcgccaaaactgaagaagcgatacttttcgtcaatcgcatgttggtaagccttcaaaatcatatcacggcccgtaaaggcagccactaacatgaccagtgtcgacttcggtaagtggaagttcgtgatgaatgcgtcaacgactttccattgataaccaggtttgataaagatatctgtccagcctgaatccggcttgatttcaccatcaaacttactaccaatggtctctaacgcccgaattgacgttgtcccggtggcgataatgcgcccaccattttggcgtacttcattcaacgtcttagcagcatcttcgtccaagcgataaaattcactatgcatcttatgatcatcgatattatcttcttcaactggccggaacgtccccaatccaacatgtagtgtcaagtaaactaacttaacgcccttatcttgaactttttgtaaaagttccttcgtccagtgtaaaccagctgttggggcagctgccgagccattttccttggcataaacagtctgataacggtctggatcatcgagtttttctttaatatatggtggcaatggggtttcacccaagctctccaagatttccatgaagatcccatcgtaatggaactcgatcatccgaatgccatcttctttttcggccgttacggtcgccgtcaacttgccgtcaccaaatgagatcacggtaccgaccttagcacgcttggcaggcttcatgagcgtctcccactcgtcaccttccgtattatgcagtaagaggacttccgcatggccaccagtttcaggcttaacaccatacaaacgagctggcatcacacgggaattgttcataacaaccgcatcgcccggattcagttgatcaataatatcgtagaaatgcttgtcttgcatctcgcccgtttggcgatccaattccaataaccgtgaactgtcccgttttttgattggtgtctgggcaatcagttcgtgtggcaaatcataatcaaaatcttcaagtgttaaactcatgttgtgacctcttatccttatttattttcagggtatgggaaccccagatgttgataacctttaattgtaacgacgcgtccgcgttgcgtccgcttcaagaatccaatctgaagcaagtacggttcaaccacttcagcgatcgtatccgtttcttcaccaatgttagccgcaatcgtggcgagccccaccggacccccatcataatactctaacatcgttcttaaaagcttattatcggtttcgtctaatccggcatcatcaacgcgtagatacgttaatgaccgcgcgacgatcgcctcatcaatggcgtcttggtccgccacctctgcaaaatcacgaatacgcttgaacaagcgattggcaattcggggcgtcccccgtgagcgccgggcaatttcgtgggcaccggatggtttgatactcgtttgaaaaatatccgcagtccgcttcacgatatcttccaaatcagcaacttcgtaataagccatgtgttcgacgattccaaagcgatcacgcaacggtgctgacagcatgccagcccgggtagtcgcaccaatcaacgtaaacggtggtaatggaaaatgcacgggatgggcggttggcccctgtccgaccacaatatcgacaaaaaaatcttccatcgccgaatacaacatttcctcaacgatttttggtaatcggtgaatttcatcaataaataagatatcacccggctccagttcattcaagagcgcgactaaatcacctggtttttcaattgccgggccgctggtcgtacggatattgacctgcatctcgttggcaattaccatcgctaacgtggtcttccctagcccgggcggcccatagagcaaaacgtgatccaaggattcctcacgcttacgggctgcttcaatatacacgcctaattcgtgcttgacccgcgcttgaccaatatactgggctaacgtttgcggacggagcgatttttctaatgacgcctcttcgtcatcggctttgtcaccggataataacttatcatcgtccatttggttacccctcccatctacttcttcatcaatagtcgtagtccttcactcagtaaggtgttggtatcagccccctgagtctgactaaacgtctccaatttcttagtgactttcttgacgtcggccttcgaataaccgagcgcttctaaggctgccaacgcatcggctaacgcaccgtcaacggcaggtgcatccacatcaagcgcggtttgaccagtcacgtcgacgttcagatcatttaacttgcctttcaaatccagcacgatttgttgggcggtcttcttgcccacaccgggaaagctcgtcaagtaagtagcgttctcttgattgatggcttgaatcagccccgcatggtcattgttagctaaaatcgcgagtgccgacttcggaccaattcccgaaaccccaagcaacttttcgaacaacgccttctcgtcagcatcaaaaaagccaaaaagactcatgccattctcgctgacggcttggtggatatacatcttaactgctgctgcgcccacctggtaacgatatggattagccgttagcactttgtaaccaatgccgctgacctcaatcactacataaccgggggttacatcggtcacttgaccgagaaaatattcgtacaccgaaaaaactcctttaaataaaacgtatgtttgcttgctaaattgtaccacattttcacagtggcttaacactggtgcaccgataaaaaccaaattttaatgttaactaaattcaaccgtaattgccgacgctcgcaacaagaaatacttgctgacacgtgaacatcatgctatgctcaaattcctagggaggtctcgctatgcaactcaaaccgtttaaagcggtgctaccgaccgcgactggtcaaactaaaattcaaacggctgttaccaattgggacagccaggatacagtgatgacaaccgcagccagctattactggtacgagctcacgctaaacggcgttcaccagtggcgcctaattgccagctggccggttgatcaaaccgtgacgaccatggtgcccggcgcaatcaacacggtactctacccacagcaacccgttattgaaatgctgattgacgactgggtcggccactttgccccaattgttgaagtgacggacaccgctcaagtgacacatcgactctggcaaattactgaacccgaggttaataccgatattacgacggcaatggctcccgtgacgccacaaaaaacgtggttaacgacagtcagtaccccactcgtcatgttagtgtcaaccagtgaatggcaaaagtttgccaccgcaccagccattcccgaccagctgattgcgttggcaacccctgctcagccttaatgaccatcaatgagcaacttcgcgctgatgccgtttaattgcggcaaaacactaaataggcttcttaggaatcaaggttgattcctaagaagcctatttagtacccatatactcagctaaagtgaccggccacgtttgcgaatccaccaccagcatgcaatcagtatactaattacaccaccaatgaaactcaaccagacgccgatttttaaccctggtgtatgatacgtcaatcgaattcggtggtgaccggctgtcaatttggcccccacaaaccctttattgacaacttgagtcttaacggtccggccatcaacctgtagctgccaaccagttgaataaggaattgacgtcgtcagcacggtcgctgcgttagttgtcgtcgtacccgtaatctgatcgttggttacttgctgatgcttcaacccacttgcctgtagttgtcgcgtccgctgacgataagtcttcccaagcggcaccgcaatcaatttagcggatttaaaatgtaaactacgaatactcgtatagttcaacgtgatcagcttacgggcgtgtttgctataccctaagttgatcaccgctgatgtccgtggctcatagtctgacatattcgtggtgcccaactgactaaaactcgtcaaattatccgttgtctgcgcagttagggaatacccactggcgcttaaattacctttcaggccatcgcggacatcattcaaataatcgaccttggtatacggacgagccgtgaatacgttggtattttgactcgtggtcagggcgtgcttgattgaggaacgccgatagctgatgccatctagcacgagataaagttccgtatttcgatacttcttaggatgctgaatagtcaattggtacggcatctggtgtccttggacatcactgaccatgcttgttaacccgttggcgttgttttcctgatttttttggaccagcttttgattcgccgcaatcaagttcaacacacggtttgacggtttcgtcagaccagttgccggcgtcaggctttcccgttgttccggcgttagtgtaatcgtatctgccggtaacttagtcaacacgttgttcgacgccccggtcgcgtgttgattccggtaaataatcactttgtccaacgtatccagaacgttcgtcgtgtccgcttgcaccgtgtaagcgacgtttttcccagtaacggctggtttgacagttttgacaccactaaccggttgcgtcgtgactgcaccttgcaacaaagcttgttcgcggtcaacagcgcttagctgattaaattgtcgctgactaatttgatgccgttgtgtataaactaacggcaacgcattcttagactttaataggatggtacctgtatgattactcatgccataaataaatttatctgcaaagatcttcggttccccagtcttcatcttaacaacctcatatccggctggtaaggcttggttcttcaactggtcctcacgtgcaaataaatatttaacacctaataagttatacatcgtcgtccgaccgtccaacgaaccaagtggcgagttcatcgcgtactcggagttgcctaaggcctgactaaatgcgcccacataaccattttgaactgaaaagtatgagccaaccgtgtgggttccgagaaccatcggtacatcgctctcagccgaacgcatcgtgtaatagttgggcgctaaagccgtccggtaaaattgaccagtggtggacaaacttttctgtgcaccatcaaaataattcttgacccacttcattgccgcaccctgccgcaactgttcggtactattagaatttgtattgatactcaaccaaccgaggccgttgttcgcgaggttcaacgtgacgacgcccaacaataacacgtagaattggcgattagttaattttaacgagcgtttggccagcaggatcccaatgaacgctaataagataaggtacgtcgcaatatcatgtttgcggatattgagataaaacccattgattaaccaaataacgacaagtagaccaccactaatacccgccaaccatttcaaatcagccgcggtcaacgcggtaacttgatccatgaaggccatcgtcgcgtaggcgaatacgagcgttgccatcaacaaccatcgattggatggtgtggaaaaaacgttgaatacagccgcaaattgaggcaacagaatacctatcatcatcacgactagcacccaattgagtacccaatagcgtttaaaatgacgtagtgtgtaaataattgcaataaagctaatgctactcaacccgagggtcacccagtattgaacactacccccattcgtcaacaaccgattgggcaaattaacataataattgattggataactcgtcaagccattcgcaaagttaaagctggcacgcgtagccgtcaacatcgcgagaagtgaaggcaccagcaggacaccggccatcatgacaccgaggccaactgctaccagcaatcgccagaacaactgaccaaacgaccgcattgctaaatggtcgcgacgccgtgaccagtatcgaaccagagcgtaaatcaggccacccaacgcaagtaggtacgcaaagtaaaagttactcaaaataacgacggcggtaatcagactgagtggtaaccagtggcgtccccgcagcacccgctcgattgcccaacaaagtagtggaaaccaaatcattggtaacaagaaaaatgggtggtgcattccgacatagaacgtgtacgcggtaaacgtatacgtcaaggccccaatgagttgactcacacgtttaaacttgaactgccggctaaaacctagaaaagccagccccacgaagtacagtcgtagcagaatcaacgcctggtaagcccattccaaatgggcgcgcgaaacaaacaccactaggtaattaaacggatcaccgaccacgtagtaggaaaaagtcgtcagctgatcggcccccaagccgagattccatgaccagctgaataattgttgtgggtggtgctgtaagatccgttgaaattccaataagattgggaagtgttgggcgatgccatccacttcccagattaatgttcggccggctaagaaaagcccgctgtaagtaatcgtcgcaataaccacgaacatcgccgtataccaggcaactagtggtatcttccgtactgtcttcaaatcaggtgcccctatcttgtaattacgtcgatgacgcaatccccatattttgccatcacaaacaatgttcctattttaccatgaacattttcacctcgtgacgttcaacctaaatcttaataaattcgtgtgcacggccgccgcgtcgcttcagttcaatctccaagtcacaagtcgattactgagcacacaccccttccgactcccagccaacacctaacgccaatcccaattatccaaggtttcaatcttagtagtcgccggataactcccaaacagccgcactaagggctgtaatccactcacggcattatcccgttgcaaattgatcgtagcgattgccgcttgatcatgacggttaggatcgagctcaaaagcagcaacttgctcatataaattcagcgtaatcaatttggcgtcccgcgcacttggatgcgcatttaattcccacaacgtcttgcgccccgccacaaatgcgggcgtggcctctggcaggtcggccaaaaaacagtacgctgaataaacctggcgataataaagtttcgtcatatccacactaatcaactcccaatcatgttaagtggtcctccgatacacaccaaccactcgttttaattaatgatagctaactatttcagccaattcaatccgaaatttcacaactcgaattatcgtcgcgagttccgttctcccaagcttaaagttatcgttaaaccgccacatcagcgacaaataaaagcgtccccaggtttctaacccagggactgctcaacattattattttcttcgataacatattcaattcatgatcattcagtattaatcatgattaaaacgtgctggttgtgtaagttcaaaaccagccagcttaggcccgctggaaacagttcgagttagcgtaaacttttttggttggttcgtcctacgccgacttccaggcatttctgccaattgccggaacgtggtgggcacagatttaagccgaagcccacgtcttaaatactggcctttcaccactgggcattgtcagaaacgccttccagtcgggatggtattcgaatggcagacggagatgtacccaacttttattggacttatcacttttcttcataaacagtaattttgtcgagcaactgtcaggcagaaaatgacattttgatagctcactatttcgaaatcactatagtaataatcgaacgtctcgacaaagtggttaatgtaaccttaaagtctcgtttaaagttctattatcaaaatagtcagcgaccaattgtaccaagttaagtggccgttcatcagccattcgagcggcttaccgactggaggggctgggtgacaatgctcagtagccaaattattcttagctggaagtgcatttcttccggcttagaataagactcgtatttgagaccgggcgggttgtgcacgggctcaaatcgacgtcggctgcgttccagcaattgtcacccagccccggaggtcggaataggacgcgcaccggctgacgaacaggaatcctactaaaattaggccagttttaatcatgattcatgattaagcaacgggtaaaacaatttaatcacgtgcttcatgactgtcttggattcgtttgaacatccgttccatgtctgaatttgtgaagtgaaccgtcacggggcggccgtgcgggcagttgaacggattctcgcaagtcggtaacttggctagtaaggcgcgcgcctgctgatcatccaaatgatgattggctttgatagcccgtttgcaggacatcatgatggccgacttttcccgaaattgggcgaccgtcaatttatcatcctgaaggatccagtcaatcatttcacgaatcgtatcctcttcttgccccgctttgaaccaggttgggtgggcatggacgatgaagctgttgccgccgaatgattccagatgaattcctagttcggctaatagtggcaatttttccttgatttttaaaacgtcgctcgtcgggtagtctaaaataatcggaaccagtagattttgttgatccgcactgacctcgcctatcgcttggcgataatattcgtaattaatgcgttcttgggccgcgtgctgatccaaaatgtacatgccatcatccgcctcagctaacaaataagtcccgtgcatctgaccaagataacgtaactgtgggaagcgttctgtgcctggtgcttcgctagtcggtgcgctcgcagctgaactgcttgcaagtggttcagcgggttcaccaaagggtaaggccgctgattcggactggtaacgctggtcaaatgtttgtaccggtgcagttgtgagttcgtcgcgactactgatcatgattggttgggtggcagaacttgctggtgattcggctggaatagtggcactagtcgcagcaggacttaccgttgacgactgtgcggaagtggtactcatcatggccgttgccgagctgggctgcatggttgccgctgccagcgaggctgcaaactgttcagtcgaagtcggcgtcgtcttatccgtcacctgatactgtgatgaagcggcgttcagattcattgcgagctggtccgtatttagatgttctcgccggtgactgccaagattggtcaatgctgacggaatcaagttcacatccactaatcgctcggtgatcgtggtgctgatcagtttggccaattctggttccttactcaaacgaacttcctgtttcgtgggatgaacattgacgtccaccaataaaggatccatcgttaatgcaatcaccgcaattggataacggccgaccatcaacttggaaccgtatcctttgataacagctttggtcaattgctgattcttgatagcacgaccattgatcagaacagtaatatactggcgactagcccgcgtcagctcaggtaaagccacaaaaccactcaatttaaaatcagcggtcgctccttgaatggcaaccatcttgcgcgcattttggacaccgtaaataccagcaatgacttgttgtaagtcaccgcgaccggccgtttttagcagctctttcgcattatgaactaaccgaaaggccaccgctggatagctgagtgcgatgcggttaaccacgtctaagatattggctaactccgtttggggtgacttcagatattttaaccgcgcgggggtattaaaaaacaaatcagtgacggtaatgtccgtcccttgccgcagcggcgcgggcgattgttgtaataacttaccgccgcgataatgaatactcgtcccagtggtgccagtactcgtattcatcaccacgtccgcgactgaagcaatacttggcaacgcctcaccacggaagcctagcgaatggacccggaataaatcttcccgcgacgtgatcttactcgtcgcatgccgtttaaaagcggtcaacacttcagcatcatcaataccgtccccgtcatcgatgacccgaatcgactgaacgcccgactcttgaactaaaatgtcgacctgcgtcgcgtgcgcatcaacggcattttcaaccagttctttgacgaccgaggcgggccgctccacaacttccccggcagcaatctggtctgccagtacagaagataactcatgaatttttcccatttccatcggtcctttcacataaaataattaagctcaggcctaccaaacagcttcagttacccctaccagtgataactgactggtgtcgatctacctgttcgtcagacgcgccctagctcatcataagcagcttattgtgcccgttatgacgcgttaaaatacgcctacttacctaatttttgttgccatttatacagctggttcattacatccatcggagtcatcgccatcaagttcaacgtcttcaactgttgtaaaaccttttcacccttcgtatccgtcaccgccggctcagcaaataacgacagctgttcatcaccggattcagtgaccggagcttcggctgccggggtctccgattctacaggctgcggctcatcggcggactcagccggcattgaaaccgttgtgttcgacgccacgctattagccgcatcactaacagcaatcgaagccgccgtcgttgacaccgtactcgtttgattttccaaactcgttaagatcttattggcgcgttgcaataaactcgtcggcatcccagccaacttggcaacgtgcaccccgtaagacttatcagcggccccgggctcaactttatgcaagaagacaagttcaccatcctgttcagtcgcaccgacatgcacgtttcgtaacccagataattcttgatctaacgcagtcaactcgtgataatgcgtcgagaacagtgtcttggcatgaatatggttatgcacaaactcaataatggcttgggcaagcgccatcccatcgtaagtcgccgtcccgcggccaatttcgtcaaacagaactaaactattagccgtcgcatgttgcaaggcattattagcttcctgcatctccaccataaacgtactttgaccggaaattaagtcatccgtggcaccaatgcgtgtaaaaatctggtcaaaaatcggaagttgcgctgatttagccggtacaaaacaaccaatttgcgccatgatgaccgtcaaagcaagttgacgcatgtacgtacttttaccggacatgttgggaccagtaatcaaaaggaccgtctcatcaggtgacatcatcacgttatttgggacgtaactctggttgcccatcactttttcaacgaccggatggcgaccatcaacgatttttaaatcgtgggacttagttaatttcggtcgaacaaagtggtaatcttcactaacgacggcgaaactttgcaagacatcgattgccgcaaccgcctttgccaatgtttgtagccgctgaattgccttcttaaccgtttcacgtactttcgtgaagagttgatactcaagatccgtagaatggctctcagcttctaaaatcaggctttcatgcgatttcagttcaggagtactaaagcgttcagcattcgttaacgtttgcttacgttcatagcggtccttcggtaattgggccaagttagccttcgtaacttcaatataatagccgaagacccggttaaagccaatttttagattcttgataccggttgtcgcccgttcttgggcttctaactcagcaatccattttttcccattattcatcgcatcccggtactgatcgagttgctcattataaccgtccttgatgaccccaccgtccgttactgacaaaggcgcgtcttcaacgattgccgcgtcaattaaatccgcaacgtcttcgactggatccagctgattaacttcatcattaaatacctgtgtgtccaattccgataagatataccgaatctttggaatctgccgtaaggatgtcttgagttgcactaagtcacgaccattcacgctaccaaaagccacccggccagctaaacgctccaagtcataaactttagtcaactcttcttgtaagttgctacgttcaaaataatgatccagtagcgtggcaaccttattttgacgcgtttcaatatcggccttcacgatcaatggccggtcgatccactgctttaatagtcgtccgcccatcgccgtcttagtttcatctaatagccataacagggtcccctgctttttaccagttcggatggatttcattagttccaagttatacttagaattatggtcaagtttcaggaagtatgacggttcgtaagcaatcgctttttgtaagtgcgcgagactccgtttttgcgtcaccgtaatatacatcaatagccgttccacgacctgttgttccaggtcgaccgtcaagtcttgcgttaagtaactcagttcagcctgaggagtgacattgttctgttctgaaattagaattcctagcgccttaatctgatcgcgcaggtcactaggaaccgaatcgtcgaccacaatttctttagtttgtaagctagtcagctcgttaattaaagtatcattagttgttaagacactcgttttcagttccccagttgacaagtcagcatacgcaaacccatattgttggtcacgctgaatcagcgcagtcaagtaattgttcgtcttagcttgttccgcgccccgctccaacgtcgtaccaggtgtcacgagctgaatcacttcgcgtttaaccatgcccttcgctagtttagggtcttccatctgttcacaaatggcgactttatagcccttgtctactaaaatatcaatataattttgcacagctcgatggggtacaccacacatcgggatgggattttccgccgaatgattccgcgtcgtcaaggtcaactctaataactgagcacctttaatcgcgtcatcaaaaaacatttcataaaaatcaccaagtcggtaaaataaaaacgcatcgggatattgatttttcactgcaaaatattgacgcatcatcggtgtatcttttgttttctgtggcacgcttaatcctactttctatcgtcaatcttaatcatcaaaatatgggtgatccggattaatcaaaatccgggcaatctttttcgcccgaccactctgtccatcaacgtcgatcacacaacccgacaacacagccggactatcttcttgcacgttgaagcgggtcggcatttgttccaagaaacgctgaataacgttctcacgggtcatccctaaaataccattatacgggccggtaaagccaacgtcactcaaaaaggccgtcccattaggcaatacgcgttcatcactcgtctgcacatgggtatgggtaccgaccaccgcacttacctgaccatccaaataccacgccatggcttctttttcgcttgtcgtttcagcgtgaaagtcgatgaagatgttaggtgtctcttcccgcaattgctcgaccaatggttggacagtcgtaaaaggatccgctaaattttgccccataaacacgtttccttgaagattaatcacggccaacttcaccgtattgaccttcacgatcgtataaccaacccccggagtcgtcgctggcggaaaattcaacgggcgaatcaacttcttagcaccattaataaaatcaaaaatttcattattatcccaagtgtggttgcccatcgtaatgacatcagcccccgcagtcaagatgtccttatacacttcttgattaatgccacggccgcgggtggcattctccccattaacaatagtaacttgtggcttgtagcgccgttttaacttaggtaagtacgtggtgaccgccgtttgaccgacattgcccatgacatccccaacaaatagaattcgcatagattgctcccttgttttaacgttataccaattattttagcattatttagccttgaaaacgtgattgaattctgctgacaactaaaaaaatgagcttaggtcaagacctaaactcacttcccggttatttagcgtaatccactgctcgaacttcccgaataaccgtaaccttaatatgaccgggatattcaagttcattttcaatctgctttttgacatcgtgcgccaaaacagttgcctgtaaatcagaaatctcgtttggcttaacgatgactcgaatttcacgaccagcttgaatcgcatagctcttcttgacgccatcctcattattagcgatcgcttccagcttctcgagccgatgaatataattctccagcgactcactccgagcacctggccgggcggctgaaatcgaatcagacgtcgcaaccaacaccgcgataatcgacttcgcttccacatcaccatgatgggaggcaatcgtgttaatcacgacggggctctctttgtacttcgttgttaattccacgccaatttcaacgtgggaaccttcgacctcatgatcgacggccttaccaatatcgtgtaataatcctgcgcgtttcgcgagtgtaacatcttcaccaagttcggcggctaaaacgcccgccaacttcgcaacttcaattgagtgattcaaaacattttgaccataactggtccgataattcaaccgaccgacaagcttgatcaagtcaggatgcatcccgtgcagtcctaaatcaaagacggcttgttcaccagtttcacggattttttcgtccatttccttacgtgctttttcaaccatttcttcaatccgagctggatgaatccgcccgtcttgaattagcttttcaagcgcgattttcgcgatttcacgacgaatcggatcgtaaccacttagaacgacggcttctggcgtgtcatcaataattaaatcaatacccgtcagcgtttccaacgttcggatgttacgaccttcccgaccgataattcggcctttcatgtcgtcattcggcaaagaaacgaccgaaaccgtggtttcagaaaccatatcggcagcactttgctgaatcgcttggacaattaagtttttggcttctttttcagactgcgctttcacttcgtccgtattttctttaattaacacggcccgttcatgcgttaattgttcgcgcgtttgggtcaaaatctggtcgcgtgcttgctcttgtgacaaggcggcgacccgttctaactcagcttgacgttgcgtgattagtgaagctgcactttgttgctgttgttcaacgcgtttttgctcattggcaatcttatcttcttttttgcctaaagcatcttcgcgcttttcaaaagtattctctttgtgatctaaagtttcttcacgttgaagcaaccggtcttcttgtttttgaacttcattccggcgttgctttaactccgcttcaacttcagcccggtaacgatgactctcttccttagcttcaaggactttttctttcttgtgagtctccgctgcccgtttggcctcagaaataataccttcggctgtgttcttggcaacgtccaattctttttcatggacgttcttgcgtacatagtaaccaatcccataaccgacaacaattgcgatgactgcgaggattataccgaaaacattcatgtttccacctccgcaccaccaaaatccagttaacataaaatcaactacaaattttcagatgttatattttgattatttacacacttgttattctaatgttagaaacgaatagtgtcaacttaaagtcttatggcaaccggtctcgacgggcaacttttgtcgtgcaaacaagctaagcgtacacaaaaaacgcccaaaataaatattttggacgttgcataacaaactgtttacttttcggttggttggtcgccgagatcgagagcagtttccgctggtgttgccttagtggccttattttgacccttgttagcattcttagcggttcccttatccttgccatctttagcctgatcatcggcctcagttgcttcctcaccggttgcatccataccgtatgcatcacgaactttttgacgaatctccgtcatgacatcaggatgctcgtccaaatacttcttggcattttcacgaccctgaccaatgcgatcgtcgccatatgaataccaagaaccactcttcttgacaatatccttttcagctgccatgtcgacaatttcaccggtttgtgagataccttgaccatacatgatatccacttcagcacgcttaaatggcggcgcaaccttgttcttaacgactttgatccggacacggttaccaataatattggttccttccttaatctgttctgcccgccgaacttccaaacgaatcgtggcgtagaacttcaaggcccgaccaccaggagtcgtttcgggattaccaaacatcacgccgactttttcacgaatttgattaataaataacgcgatggtcttcgttttgttcaatgttcctgataacttccgaagggcttgtgacatcagccgcgcttgtaacccaacgtgtgcgtcacccatttcaccttcaatttcggcacgtggcactaaggccgcgactgaatcaacgactaaaatgtcgaccgcaccactggaaactaaggcatctgcaatttcaagcccttgttcaccagtgtctggttgtgagagtaagaggtcatcgatgttgaccccgaggtgttccgcgtaaacgggatccagtgcattttcggcatcgatatacgctgccgtgccaccctgcttttgaacttcagcaaccgcatgtagtgctacggtcgttttacctgaactttcaggaccatagatttccacgatccggccacgtgggtagccaccaacacccaacgcgtcatctaaggccaacgatccacttgaaatcgttgagatggtcgtctgggcagcatcacccatccgcataatcgcccctttaccgaaattcttttcgatcttttttagggcagtatctagtgctgctttccgtgcatcagccaaattatttcctcctttggtgctcgtttctaactcttaatatcatagctgttcaaagttagaattgcaagcaaaaagcgaacaaaagttcgtattattttttcaagtccgtatcagcgtctagtgcatgtctcaataggtctaatccggccatcacactgcgcgttcggatttgttggcgactgccagcaaaatgatactgcttggccttcgcgggttgataccggtaagcaagaccgatccacaccgtcccagctggttgtccctccaaggtcccgggaccggcgacaccggtgaagctgatgccaaccgcagtattaagctgctgcttggcaccgctcgccatggccttagcagtcgcttctgaaacgacgccttcagtatcgataatcgcttgtggaacgttaactagctgatgtttggcttcattcgcatacgttacaaaaccgcccggaaaaattgcggagaccccggacacactgccgatagtactctgaaacagcccggctgtgaggctttctgcggccgtaatgctcagtttagccgcaatcatttgattaataacggtggcaaccaatgaattatcgtccccatagccgtaaaagaacgccccaatagtggctttggtctggtggtcaactttatcgatcatggccttagcagccgcttccgtctcagcttgagcactcagccgcagggtaacctcgttagtcttggcatagggcgcgatcgtaaccgcctgctgcttatcaatcaaggattgcaatctggtcgctaattcagactcactgatgccataaaaacgcatcactcgcgaatagattcgggcttgttccccatatgctgctgccaatttcggtttggcttcagaatcaaacattacggccaattcacggggtgggcctggcaataataagaagtcagcactattttctgactgataaaacgccccaacagccattccgttatggttggtcaacggttgggcccctgccgggtataatgcttgtaatcggttgttagccgtcatcactttgtcattagtagcaaaccaggccgtaattttttgcattgcagcctgatcttcaactaaggcaacattcagataacgtgcgagcgtctgtttcgtcaagtcatccttggtcggccccagaccacccgttaaaataactaagtcattccgctgggccgctatctcaatgacggctgacaaacgttggggattatcaccaaccaccgtctgataatagctgtcaattcctaattcggccaatccacgtgcgatgtacgtactgttcgtgttcgtaatctggcccagtaaaatctcggtaccaaccgcgattatttctgcttgcatgccatatgcctccccgtaatcctatcgattacactcagtgtgggcgcgatgattagcgtcctacattcagtatatacgaaaatgacgagtgaccccattaaaaagattagcattttcaaataccaccatcttacctaaccaaccaacgccactcattattataattatcagctaccagagtcacgatcacttaacgcgtgcaatactttggcgagatgcaaaagcgtctcaccgaatgcaagactcggtgagacgctcatgattaatttatttgaagccatctgcaaacacgtcacgattctgaacaaaataatcaatgccagaataaataacgaagaataagcagatatataacataattgccgcaaatggaatgtggattgccgcaaataagacattgttcagcagcaggaagatgatggcaatcatttgtgtcgttgtcttaatcttcccgggcatagcagcagccatcactttaccattattttcaacgatcaataaccgtaaccccgtcaccgcgagttcacgacacatgataatggcaacgacccaatcaggagccgcatttagccgaactaaaatgatgaacgcggtcatcactaacatcttatctgccaatggatccgcaaacttcccaaaattcgtaaccaagtgttggccccgggcaatcttgccgtccgctaagtcggttaatgacgcgaccgcaaaaatgacagttgcaaccacttgggtgaccggaatggttgttccagcccacacaacctgtccccaactaaggggtaacaccataataagaatgaaaactggaatcagaataatccgaaacaccgttaatttattaggtaaattcaaagtacccgcctccttcgcaacgttatttgatggtcaaggtaatcgtccgaacttgtgacgtactgttcttcggattaaagttgaacgccttaccattgattgttacggtcgtggcagttgcgttcccaaactggaacttaaccgtcgtggcattacttggtaacgttaacgtatgtgagccatccgccttaagcgtcccttgccaagtctgagtaccgttagtcgtaacggaagtccaagcagccttagtggacttgatgaccactttgttcttatccgcaccattcgtcaaagtataagccgtatcgctactgccgtcagccttgatggtttgttccttagcagaagacgctttagaactagactttgctgatgagctagctttcgacgaacttgattgcttcttagaactcgaaacttgtacagaagaactgtccgcactcgtgctagagcttgaaccagcgtgcgtgcgaaccgccataaaccaaataaataacaaaatcaaaaccacgatggcagtgacgatgatcgttggtaaatagttacgcacgcgactcgctggtgaagccggttgttcgcgactagcaacccgggtaggttgaacttcatcaacgttttcaacgatagtttcagtatgaacactcggtaattggtctcgatattcttctaacaacgcgttaccatctaaatcgactgtttccgcatattgcttaacaaacgcccgaacgtaaaaatcaccgggaagtttatcgaactgttcatcttcgattgcaatcaaatagcgcttctgaatcttggtgatttgttgcaaatcatcaattgtgaggcctttcgctgtccgggcagcctttaagcgcgccccaatcgttgttgtttcttcgttattttcactcattgactttttctccaccctaagtctattttcaaaatcttacggttaatagtatatcacagcaactaaatttagcagccccatgaccattaaatttcagatttccttaactctttgcttgtggtcgaatctggtattcactgattgcctgagaagtcaataattgttcagcaaccgtctgcaagtctgcaaggggcaactgatcaattatacccggttcatcaaagattgtcgccgtcccgaatagccgttgatcataccggttcgcgattgcctccaaggagttcgccatgaagacgacccgcccaatcatttccttcttgactaatgcgagtgctgcttcctgaccaactacagccgtccgccagttttctagcacatcaatgatggctgcatcaaactgggctggatcatccgtttcaccactaaaagtgacaaaattaaatccagactgtaattcgaaatcataaccaaacgtatcatcgatgataccctgatcatataatcgcaaataatctgctgacgtatcgccaaacaataattctaataaaacgttaaccgctgcacggtacttcaaagcagcagcccccgcttcaatcggcagcaagcctttgacaccaacgattgatttggcccgattgactggcatatcaatcgtccgataaggaataatgtcatgtccatccgttgcggtttcaggaatcttacgttcaatcggttgaaaggcagcaaattttttagttgcttgattagtcgtaatccaccctaacacttcgtctggatcaaaattaccaaccacaaataacgtcatgttctcaggatgatagaacgtccgataagcggcgtacaagtcatcagccgttatcttagcaatcgactcagtcgtccccgcaatatcatattgtagtgggtggttcggatatagattaccaatcattccgaaatacaggcgccaacttggatcatcatcgtacatctcaatctcttgcccaataatgcccttctccttgtcaactgtcgctggcgtaaaatacggatcttgaacaaaatctaagagggtcatgaggttgtcctgcaggtgccgggtagctgagaacaaatagctcgtcttcgtgaagctagtgaaggcgttcgcgctcgccccgtactgaccaaaaatttgaaacgcatcatggtcagccttctcaaacattttatgttccagaaagtgggcaattccatctgggaagcgttgcatttcagtacttccggctggaacaaaggtattgtcgatcgagccatagttcgttgtaaacgttgcgtacgttttgtgataaccggccttaggtaacaacgtcaccgtcagcccattatccaactgagcttgataacaactttcattaaattgatcatatttttttactttcatgcggttaccccactcaagaagaacccattattaagggtcaccatcttcgcgactgcaatgatctgttcacgcgtcacactttgaatctgccgtagccattcagtatccgtaacgcgttgttgcgttaaatcatcgatcaaggcttgcacagcgaatgtccgttgactatccaaactggactcaaaatcgttgatcaagcccagcttcagctgttcaactaaatcatccgtaaaatcaccggcttgaatcgccgttaattgggccgcaataattgctaacacttggtcatgatttttgccatcaatcccagcttgcaccttaagcaccccacggaaagtatccaatgagctgctggcatagtaagccagactcgccttttcacgtacattcataaacaatttagacagcggtgacccaccaaatagttcgttgaaaaccaaggccgcgtaataatgattgccacgataaaagactggtaaatcataacctaaatttagcttcgcttggctgagtgcctgttgttcactcacttcgacgtactggtttgtattatgatgttgataaaatggccgtgggcgccccgccagccgatcctcaaaaccagcttgttgccactgagctaaaatggccgcctcatcaacgtcacccgtcacgatgatatcaatttgatcattttggatcatcatttgataatagtcgtacaaaccttccgcagtgatggctgccaaatcactcgccgtaccgtaacttggcacttgttgcgcaggttcatccgcaaacaacgccgtatttaactgctgtgcggcataatattgcttatcatcagcgaccgacataatcgccgcttccaaattctttttttggcggtcaaacgtcgcttgatcaaactgaccgtccgccactagcggttgtaaaacgacttgttgtaaaaactggatggcctgatttgtcagtggctgatccgttgccaaataccgttcattcgcaacggtgatggctaattgcaagttatgcgttggtcccttacgactaacacccgcaccaaacgcagcaccatacatgccagccaatgcgttggctaacgcccgctgatctggataatcacgagaacttgtttctaataaattcgataatagcgaccgctgagtaattgtttcacgtgcaagcggtgcccgaaaattgataataatctggttggttttaaattgatgactctgaaccgtcgtcaattggaccccttttgctaactgagtttgcaacatgtttcctccttgcatatgtaataaataataagcgaaaggccggattgacgcaactttccgtcctattgttttttttattttcagattatggtcgccaaaatgattattttcacgattaaattaaattctcgtgagtggcaattaacattgccaagtcgcgatttgtctgctattcttttcattattgataaaattaaggagcggttaatgtgaaagtaattaaatttggtggcagttccctcgctagtagtcagcaactgcaaaaagtcctcgcaatcgttgaggctgattcaaaacgtaaatatgtgattgtatcggcccccggtaaacggttcgacggcgacaccaaagtcactgacttacttattcaatatgctcgtcaaacgatccatcatcaagatacgcaagccattgtcgcaactatcattgaccgttatgcagaaatcggtcacggattcaacgtccctgaagcccaattgacgccgatctttgagacgattcgcaacttaccaaaccaatcatacgccgacaatacctacctgatggccgctttcaaagcacacggtgaacggctcaacgcgcaactggtcgccgccgtctttcagcaaagtggcctcaacgcgcgctaccttgaccctaaagatgcgggaatggtcgtcacggacgtccccgatgacgctcagattatcaagagcagttatgaccagctcgccaagtgggcggacagcgaacagattctagttattcccggcttctttgcttacaatcgcaacggccaaatctgtaccttctcacgtggcggctctgacattaccggtgcgatcattgctcgaggcgttcacgctgaacgttatgagaactttaccgatgttgatgcaatctacgcagtcaatcccaacctagtcgcaaaaccagcggccattagtgaaatgacgtttaccgagatgcgggaactttcttacgctggcttttctgtctttcacgacgaagcgttgattcccgcgattgaaggtaacattaccgtcaacgtcaagaatacgaaccatccggaggcccccggaactttgatccagtcaacccgcgaacccaatcccaactacccagtcaccgggattgccagttcttctagtttttgttcactatacttacgtaagtatctgctcaataaagaagttgggcttggccgtaaaattctgacaattttagaaaatcatcatattagttatgaacacatgccatctgggatcgacgatttaaccatcatctttgatgaacatcagttgacccccgaattagagaaaacgctagtcgccgaaatctcagcggccatcaatcccgatgaaatttactttacgcacgactactcaatcttaatgctcgttggcgaaaacatgcgcaaccgcgtcggcatcatgtcacgtgccgccaccgcattagccaacgacaatattaaattaatcatggtcaatcaaggcgcctccgaaatttctattatgttcggtgtacacgacaatgatgccgatcaagccgttattgcgttatacaaagaatttttcgactaacccatagatgatggctttgatgtgtacgccacgcaggcaatcaatgcgccggatggccgcgcgttagccgttagctggattggtttacctgaaattgcctatccaactgatcgtgaaaattgggcccattgtttgagcttagttaaggaactaacgcttaaagatgggcacctctatcaaaatccagtggcggcggtggctgacttgcgaacgacgggacacgacctagtctttgagcaacaacgggcggcggtgacggacttgaacggcagttttgaacttctattgacggttcctgctgataaagtggtcacggttaacatcgctgatcagcaggagagcggtcagttgcaagtgacggttgatgccaaccagggccacgtcctgattgatcggcagcatacggggaatccgtttgccgaagattatggtcagactcgtcaagttgagttaacggcccataagacgataaaaatccggctaatcatagatgtgtcagtctttgaatgctatattgataatggctattccgtgatgaccggtcgtttcttcttaaacgctaccccgagtcgccttaacgttcagggcgaccctacggcagttaccggtaaagtctgggaatggcgccaatcagagcatactggagtcgataacaatgaaaccaaaattaaatgatgttgcgaagctagcgggggtctcagcgacgaccgtttctcgggtcattaataaccatggctacctgagtagtcagactaaagaaaaagttttcgcggcgatgcgcgaactgcattatcagccgaataacatggcacgctcactgcaaggaaagaatacgcgtttaattggcgtcattttttcagacattagtaatccgttcttcggtgaactggtgtcccggattgaaaaaatcctgtttgctaaaaattacaaggtgattttatgtaatagtgcggataatccgcaaaaagaacgcgactacttacaaatgttgatggctaaccaggtcgatgggattattgcgggtgcccacaacttaggtattgaagaatatcaacaatacggcttgccgattatttcgtttgaccggtacttatctgacaatatccccatcgttagttcggataattaccaggggggctggctagcaacccagacattgcatcaggcgggggcgactaacgtggctatttttactggtaagtcacacgctggttcgccaacgaatgggcgtcgcgaaggctatgaagcctacttaacatcccaacagctcaccccgcatgtccatgaattaccgtttgaattgacccccgcactgaagatgatggaaattaagacgattatggcacagcatcagtatgatggtattttttgtagtgatgatttgaccgctttactagtgctcaacgtcgcgcggcaactgtcgttagcggttcctgatcaattacgcgttgttggttatgatggtaccgcactcatgcgtgattatcattctgaattaacaacggtagaacaaccgttagcggatattagcacgttgctggtttcactactattacagcggattgaggatgcgaattgtacactggaatcaaaatatacgttaccagttaagctcagcaagggcattaccgcgtaactaaggagttaatcataattatggcagcaacaatcaagtggtggcaacaagccgttgtctatcaggtctatccacggagctttcaagataccaatcatgatggtattggtgacttaaaggggatcacggcccacctagactacttaaagcaattaggaatcgacgtcatttggctcaatcccatttatcgttcacccaacgatgataatggttatgatattagtgattatcaacaaattgcggccgactttggcactatggctgattttgatgaactattgcaagccgcccatgaccggggtttaaagatcatcatggacttggttgttaaccatacttctgatgagcatccgtggttcaaacacagtcgccaggaccgtaccaatcaatatcgtgatttctacttttggcgctcaggtaacggtaaaaaggcgcccaataattgggatgcggcttttggtggttcagcatggcaatatgatgcgcagacccagcagtattatttacacacgttttcaacaaaacagccggatttaaactgggagaatcagaccttacgcaaggcagtttatacgatgatgacctggtggctgaataagggcgttgacggttttcgaatggacgtcatcaaccagatttcgaagttgcccgggttaccggatgggccgctgaaaccacacagtcaatttggtgatgcccgggtaacgaacggaccgcgcgttcatgaattcttgcaagaaatgaaccgagaagtgttgtcaaagtttgacatcatgacggtcggtgagacccacggggtgacaccggcggatgcgctgaagtatgcgggtgctgaccaacacgaattagatacggtctttgaatttcaacatctgcgacttgataatagtcagcacggacttggtaagtggagtacgcggaagcccccgttagtggcgctaaagaaagtcattagtgactggcaagtcggacttgaagggcgggcttggaacagcctgttttggaacaatcatgatacgccacgagcggtctcacgctttggtgatgaccgaccagcatatcgggtacgttcggctaaaatgctggcaacgtgtttacacctcttacaggggaccccgtacatttatcaaggtgaggaactggggatgactgacgctcattttactgaactagccagttaccgagatattgaatcgctcaatgcctatcgtgatttagtgactgagcgccagctgctatcaccggcagatatgctggcccgattagcggcgcgttctcgggacaactcgcgaacaccgatgcagtgggatacggagactaacgcgggctttagtgatgcgacgccatggctcacggtcaatcccaactatcgtcaaatcaatgcagccgccgctttggccgattcggattcagtgtggtactattaccagcacttgattcaattacgacatcaataccccttagtgacgttagggtcgtttgagctcttgtgggccgatgatccgcaggtgttcttatatgaacggcaatgggagggtcagacctggctagtttgttgtaatttcacagctgagacactggcgcgaccactggatcaatatctgacgcccacggccaaatgcttgattagtaattatggcgaccagcagctaaataaattacggccttacgaggcttgggtctaccaactcgcataggtgtccgaaacttggcgaattgaggtggcgtttgaaatgcccaagcgttacgatcagtgctaacctgctaacattagcgtgaattgggttgcttgaaattcgcgatagctccagcaagcggccggccaactaaaaaactgctttcaaaaggatgacttttgaaagcagtttttttagcgcgcgacgaccacttgacccacgtggggttcatctagtcgttggtgaccttggatgaagcccgtgaggttaaacgggagtcgttcatcgatcgtcgtggtcaattggccagtatctagcaacttgaatagtaattgtaaggcggcctgatcagaaatcacttcggtcggttggattgcttggaaacgaattgatttactagtggctggcaagtggcgggcgaatgacgcgatggtcgcatcaaatttggccattgctaagtcatctttaccgccaacaccatcgatagcgacattgatcacgacgtcaccgcggtcagctaacacgtggacggggtcttgatgctgatagtcgacaaattggtcgactcccagtgtcgcaatcaggtttgcataacggccactggcaatcgcaatgacgcgggcgcctaatcgtttggccaactgaataattaacaagccgactgggctgccagcgcctttaacgatcaccgtttggtcggcctggatgtctgcaaagtagcgcaccgttttgtaggcaataatccccggcgtgactaagctgacggcggtgaccgggtcaaggccggttggaatggtcactgctagatcgctgtctaaacaaacctggtccgcgtaagtatggttcgtgtgggcggctaccactgtcccgacgtcaaagtcagtgacagcagcgccaacttgactgatctgcccaatgacatcatgtccgggaatatgcggtaaggcaacgctttgaatggtgcccagccgttctaagcggtcctcctcggttaggttgacggccaaagtcttgattaataattgattatctgctggaatcagctgtgattgtggtagttcttcaaatacggtaggtcccccaaatttttgatacccgtatgcaagcattgtaatccccctcctcgtgtctaagttcgtgagttgatgcggcatcctaatgtgacttattaaccaataaatcatgcggtatcaatttacgaatggttagactgatccaaaaacatgctcttgtctaattgtagcgagtagtgcgggcgaatcacaagcaggaacaattatattccgggattggttcggtcaccgattaaattaaaggcggtatttaaaatccagtgacttcactttttactttaagtcgcgggactcagtcgtcaatcgagcgcctaagtataaatcaggtggcccgggttaaatcacgcggcctagtctaaatcagctgcttcgttggctggccgatgcttcaggccccagcctgtgaaaccactgataattgagaataccggtgatagtaagctgaagaaacagaatggcaggtaagctagggttgatacgcctagcgtgttagcggcaagggccccggcaacaccccacggaatcaggtaattgatgacggtcccaccgtcttcaaggactcgactgagagctaagttagccaagccgcgctgattaaaggtcgtcttgaacgctttaccaggcaagataacggaaaggtactgttcgccgacaaagatgttgacgccgatccccgctaaaatcgcagccgtaacagttgctccggcacctttcaaacgcttagttaagggcaccatcgctgtctgaatgaggttgaatttcatgagtaggccacctaacgacagggttaatagaatcaaggagaccgtgctcatcatggcactgataccgccgcgcgagagtaaggcgtccacgccagcgttaccagttttggcgacaaagccagtctcaatcatggtggcaatcttagttaaggcaatatgaggctgctcgataaaaatcatgacgatggccagaccaatattcatcaacaaggtcgcaatggctgggactttgagtagggcacaggcaaacatgacgacgagtggcaaagcggcccaccagctgatggtaaagttgctgttgagaacggtcaacgtcgtttgaatcttgcccaaatggctttgtgttgcggctccggcacctaaaacggcgtagagtgctagcgatacgacgaaggcgggaatcgtggaccacatcaggttgcgaatatggtcgaataaatctgcttcggcgatggccgccgccaggttggtcgaatcggacaacggtgaagtcttatctccaaaaatggcacctgagatgatggccccggcaatcaaagccgggttgatgcccattgtcgtcccgattccgaagagggcaatcccaatcgttgagataatcgtgaaggcactcccaatggaagttccgataattgcacaaacgagaaaaacggatgggacgaaccactgcgcagagatcagatgaaacccaaagaccatcattgaaggaatgatgccggctgcgatccaaacgctgatgagtgccccgatgagtagaaaaataaaaatcggaataatcccagttttgataccatcgataatgccaccgtgaatgtcatcccagtgggcaccccgaatacgggcccataaaatgatgagggcaataacgagaataacgggggtctgtggtgacaagccgaacttaataacaccaagtcccataattgcaagcataatgagtaaaacgagcaaggcttccggtaactgaactggccgccatttttttgaattaggcataataattaactccttttgggtcgctaaactggcattgagtagcccagtacggactgccgcaacggcggttatgcgccgataatagtgggtggatataaaaaatcgtccccgttgcataataatgcaacagggacgattgattagaccgtggtaccacccagtttgagccacagtatgactccactcactagcagttaacggctctagttgttatccgccgggcgtacccggacctctcctaccgtatttcatcgagattaacctgatcggttcgcagcacccaccgacttcctgacgcacagttaattcgctacttgaaagtaagattatcgttcgttatttgaatataagcgataatagcatggcgtttttgattcgtcaactaagatatggctagaatcatgttaggccaacaaataaatgacgatttgtgggtacgcgctaatgagcgacaatggtagaatagttagtgttgtaagcggtgccttttacggctgaccgtaataagttttttaaagcaaatttttttagggggatatcatatatggctaatcaatggtggcaatcagcggtcgtttatcaggtttatccacggtcgtttcaggattcaaatggtgacggaatcggggacttaccaggcattacacaacggttagattacattaagcaactcggggcggatgtcatctggctcaacccaatctaccggtcacccggcgtcgataatggctatgatattagtgactattacgatattaatccagaatttgggacgatggctgattttgatcaattattaacaacggcccacgcgaaagggctaaaaatcatgatggacattgtcgtcaaccattcatctgatcaaaataagtggtttacggcgagcgcgcaaagtaaggacaatccgtacgcggactattatatttggcgtgaccccgttgatgggcatgagcctaacaactggggtggctttttcggtggctccgcttggcaatacgtggctagccgtgatcagtattatttgcattcgtttgcggtcgaacagccagatttgaactgggataatccgcaactacggcaagcggtctatgacatgatgaatttctgggtcaataagggtgtggacggtttccgcttggatgtcattaacttgatttccaagcctgagagctttgcagatgggcagtcagaagctggcgaaccatacgcggccatcggtggaattattgccaatggcccgcatctccatgaatacctacaagaaatgaatcagcaagtgtttgcaggtcatcaattgataacggtcggcgagacgcctggggctacggttgctgatgctaagcaactggcaagcagccaaggtcaggaattaaacatggtgtttgaatttgaacacatgggtctggacggcaatccggatccggcgctaggtaagtggaatgaccaacccgtccgactggttgacctaaagcagagcttgtctaagtggcaaacgggcttacaaggaacggcctggaatagtctctattggaataatcatgaccaaccgcgaattgtgtcacgattcggggatgaacggccagtctaccgggaacgctcggccaaaatgctggcgacgctgctgcattttcttcaaggaacgccttacatctatgaaggtgaggagctcggcatgacgaatgcccactttactaagctagctgactatcaagatttggaatcacggaacgcgtaccatcattttgttgatgacgaacaggtcgttcaacctgaacggatgttaggttatctcgctcatatgtcgcgggataatgcgcgtaccccgatgcaatgggatgacagccagaacgcggggttctcaacggcgacaccgtggctagcggttaatgccaattatctgcggatcaatgcccaactcgcacaacgcacaccgggatcgattctgagctactatcagcggctgattaagcttcgacaccaattgccagtcatgacgacgggtgattatcggctattgtcaccggatgatgcggccgtttatgcctacgtgcggcacgcgggaacacaacatctgctagtgatttgcaactttacggcgtcgacccagacgcggcactttgcagaattacctgccgatgcgcgcctgttgatcagtaattacgatgaagatcatcaagacgtattgcgagcgtacgaagcgaaagtttaccagttctaggtcgtcattagcttcgtaaccggagtggtaaatacgatttttaatagcggttgtgtgataacgagcgcgaattaatcgtgtgaatttaactatgatgatttagtcaaaaatgcgccccaataagagcgcccaacctatcatgcgagataagttgggtgtttttattggggcgtatgtgtgattgtgatcaagttcgtggttaagatttttgttcagcattgtcagctgcgaacgttttttcaataatgtcgataacctgcttgaccaggccaattggaaattgatgggcccggcgaatcaagttgatgtgcacgctaggaacctgaacgtcgtcgaacgggatttcaacgagaccatcgtcttcaccatcgttaggggtcgtgatgtcggaaatgaagcctagggccaggttttctttaactaatcccttgatcaaggtgctgctatcagattcgaacagaacttggggttcaatcgaaagctgttcagcaagttgccggaaaactagtttatttaagtaagttgcattaagcagcacgaaaggtgactttagcgcctcggcaaaggtcgggtgttcagactttgctaaggggtgttcaggattagcgagaatacggaatttaaatggccgtaatggcgttactgctaaccgttcatccaatgtttggtccaagttgccactgatggctaaatcgagttggccggctaacacttgtttgacaagttggttggcccccatttcaaccgtatggacactgctaagcaagtcttgttcgatgattggctttgttaatgctggtaaataatgctcactgacggatggttcgataccaaaccgcagtgtatgttgacgtaagtgactgatcgattcgttaacatgctgccagttgttgataatgtcgttggctgcgagcaatagttgctgaccactaggcgttaacactagagccttggtctttgcttggcgaaagaacagcgtcacttgaaaatgacgttctagtcgtttaattgcttgggagattgtgggttggctaacgtgaaaatcagcagccgtttgcgtataactttgagtgctgattaagcgttggaagtaatacaagtctttaatgttcatgaaaaatgtagcctccataaaatattaatgttggttgcgcaattaatagtcgcaggtaagcaggctccgactgattgattaaagctggttattatacgtcatgttaatcataccattgttgtaacgaatagtgtcaggataattcgcaaaaattagtttggacaatagttaacgtgcttaaactataatgattattaataagaatattagtgctgattggtacagatgcggcgttaccggtaaaatggcttttgagtcattatataattttatcagttaaagggttgtcacattgttttaattaccatgtcgcgtcggcctgattagtcactggaaaataagttaaaaaagtcgtattgcattgttggtagcccattggagataaaggttaaagtgttaaagcgataagcgaatgttatgcagattaagaagcttacaagttaatagcaaacgattagtaatagaggtataaaaaatacttatcggttaaggtgctgttatatatcagctgataagtcaataattggtctatgtgctggtggcagtgctattatgccccgttttccagcataattagttgataggcaactaaataagttaatgggtttaaattataaacgaaacgaatggcgtcatttttgctgtttgcgattagatagatttatattaatcagcataaattattttaattagctaacggctaccagaagcttgccaaagtcaacgaaatgcaacttttgtataaaatattataatactaatatcgattaatgtctccagaatgttgatattacagtaaattaattaagtgtacataaataaaaattatacagatgcaaaaaggctttttgaaacaaatattgctagtccgcaattgctacctgtgggcgctgaatttcactaaaaaggatattcaaatttgcagaatgtggtttataattaaggtgtgtaatcggtttaaaagttttaacttatatagagaaaggaggggatataatgcgattaatcgatttcaagacttggataatggggacggccgccatgttgacgttggttgtgacaaaccaaacggcgaatgcggcggatacagccactaccaccgccactgaaacaacacaaacttctggttcaagtacgcttgctaatcaagtggtgttgcgacaaactacgagcagtagcagtagcagtagcagtagcagtagcagtagcagtagcagtagcagtagcagtagcacgaaagtatcagcaactagtgctgcgactaaaacggcgaccagcaaagcagtcaccgtgtccgagtcatcaactcaatcatccaacacaccggctactagtcaaacgacttcaagtatgaccaccgctcaagcaacatcggacagtactgatacgacagcgacatcccgggcggcagctaatgccaaagcggatcaacaagcggttagtgtgaaggcgaataacgagcaagcaacgacccagaaccagcaacaaacgactaatatgtacagtggtgtcgtcaccagccaaaaagacgcaacgacatcgacaacgaagtcggatcaggcaactgcgcctgttgcgacgctgtccaggatgagtcgagccagtcttcgcagtttagcacaacgggcaacggttgcagttcagggactcgatgccgctgacgcaacggtgactgacgatgatggtgtcacgtataacgcaacggatgtattgagtctgtatgcgaactatatcgcgaagtatcattggtcgatagccgatgacgttaccgtagctgctggtagtacggccacggtgaccttgcctgagaacgttgtctttaccaatggtacgcggcatattgatgtccaaaagtcagatggaacggtcgtcgggacttttacggccgagactggtagccaaactgggacactaacttttaatgattattatgcaactagcgatagttataatcgtcaaggggacttaacgttctatgttaccgggactagtgcaaccactggcagtagtacgactgggattaataaggtcggctgggcagacagtagtagtttagatgccgatggtaatcccaccaaaatgatctggcaagttgtcgcaaacattaacagtgaaaagtggcagcaagtagcgattgttgatcagctcggcctttatcaaacacacgaaggtactatgacgttggaaactggtcattatactgacggcgcctttgttaaagacgcggcactgggaacttatgattttgcgacacagcagtttacctacgctgatggggtatcaacaccacaagtaactgtgacggttgtgggccagcagatgacaattaatattgaccaattagatacagcggtcaatatattttatgaagttggcctgacagcaggacacacgtataccaataatgcgggcgtaacgtatgcacctgtcactggagatgcgactgatccaaatgcgggcagttcgacaggtgaaccaaagagtgaacagtcgaacgcagccgtaagatttggtggttccggaaccgctagcgatgacattcagagttacagtttggtcattaacaaaactgatggtgacggccaagcagttgctggtgccacttatcagttggaggatagcacgggtacgatacttcggactgatttggtgaccgattcagctggacagctacgcattggtaacttgtcggctgggacgtacacgttagttgagacggcagctccgagtggctaccagattgacacggccaagcacgtcttcacggtatccgcagcccaagcaacggctaacgtggtcacaggtagtgtggttgaccaacgaattgctaagacgacactgactgttaataaagtttgggctgacgtgccggctggtgtgcaaacgccgaccgttgaagtgacgttacaacgcaatggtcaagcttatcagaccttgcaattaacgtcagcaaatggctatacaggtactttcagtgatttggatgtgacggatgtttatggcgatgcgtatacgtatacggtgactgaaacggccattgctggctatatcagtagtcaaacaactagtggtgagacggtgacactaacgaatacgtatcaaaccggaaaattaacggtggtcaagacggattcgagtggtgccaatcggttggccggtgcggtctttgccgtgaaaaatgctgctggaacgctggttgctcagttgacaacggatgccactggtcaagcgcagctgacaggtctggcacaaggcacttatacggttagcgaaattcaagcaccggatggttacttgatcaatacgcaggcgcaagttgtcgtgttggatgagcaaagcgcttatcaagggcaattagtttttgccgacgaggctgaaccgagtgaaccgagtgaaccgagtgaaccgagtgaaccgagcgagcccagtgaaccaagcgaaccgagcgaaccaagtgaaccaagcgagccgagcgaaccgagtgaaccaagcgagccgagcgaaccgagtgaaccaagcgaaccgagcgaaccaagtgagccgagcgaaccaagtgaaccaagcgagcccagtgaaccaagtgagccgagtggaccaagtgagccgagtgaaccaagcgagcccagtgaaccgagtgagccaggcgaatcaaatgaaccaggtaagcccagtgaaccgagtgaaccaagcgagccaggcgaatcaaatgaaccaggtaagccaggtgaaccggcgctaccaggacacactgacgagaacactgattcagatcaggttgtcacaacgaagactgagacaactaagttagccaagcaaactaatttagtaaccacggctcagccaacgaaactgttaggacagccaacaaaattagtagcaacttctaaaccagttgttaaagttacaaaagcaactaatcgcaaatcgacgcaacaattgccacagactagtgaacaatcaatgaattggctaatgattttgggctggttcttgctagggctaacagttgttagtcgtcaacggcggtttaattaaccaaaaaggctactggaatttcgcttccagtagcctttatttatatcatagataagtgtcgccacattaccgacgattttgagatgtgcgttggtcatgcttaattctgactggttgagcagcgggaacacgggcaccagcgacgacgccggcaacagcagctagtccggctgcggctaataaacctgctaataacatgggcaagacctcctcaatagttgtaaaaactcgtcttttgatacttgcagtttaggcgacttattaacaaaaatcaattatttaaccgtaaattagtgagaatttgaataacttgaaatattcttaagtaattgccggttattgttcattctggcaagggcggccgcatcatttaaatactcatgaatttgatccggttcatcggataattgagcctgtaagaatttgatgcgcgctgcgtaataagtgacgtggaatcgcgcacaaatctcgatcccgtagtttaataactgcaaactccgcggtgtatcattaatgttggcgtaaaaagcccccgtgtaataagctaagttaatcacgcgccaaacactggcggtcgtttctagcggtaggttcggtagggcatggcggactttttcaaaatagtactgagctttatcgttatcctggttctgctgataagcgatcccgataccgcagtaggccagctgggtatagattgtgatgtgggcctcgtccaaatcggtgatgatttggtcgaaattaaagatgacatcactgattgggtggtggttaagggcagcaacgtagccctttaggtaacaatattgtaatttggtttcgcggtcatgtcgcggcatatccgcagccttttcaagttgtacttcggcatcttgatattcagttgtaatgaggtcgaactcgacttgttccaaaatcttcaaaacggcggcatcagcgacgcgttcagttggaaagacatcttccaactgtaggttgagccgctgacaaagttgggcaacgatccgtatggcaggtgctttgccattattctcaaacttacttagtgtcgcctgagtacaaatgccttctgctagggccttttgtgaaagtcctagggctttgcggcgggcgatgaaaagctcaatgttcataccatcaacgcttcctttacatatttaagtcataattgaaacagctttcatttaccctaattaaaaactttttatataattttgtcaatatttaaacataatcatgcatattctaaaaatatatcttgactatataaaaaacgctcgctagtcgttgctagtgagcgtctgtgatttatcggacagtttatttcgccatataggcgtctttgaagttatagttggtaccggaagtgttgtagatcaggccctttaacttagggttgaccatctgtgccagcgttgtttgtgttaatggtgcaacgccttcatccgttccaatggtcttttccgctttgcctagagcggtccaacgtgctgttgaatcggtcgcttgctcggcctgcttgacagcagcatcataatcagcgttcttccacttaccaaagttgtaatcattcgtagaagtgagaatgcctaaatcagagatggggtcggcgaagtcagcttgccagccagaaatagcgagttggaaatcaccagaagtttcacgtgccagccggtttttgaatggcaaggtaatatcggtaatctttaaaccgggtagttccttttctagctgtccctgaacatactcggccgtctccttggtctgatcaatattatcgtgcgtgagcgttaaggttaatgactttttgccggtttcttttaatccttccgcccacagtttcttggccttggcgttgtcttgagttgtggccgcactaactgcgttttcagtcgcaaaatcttcaccggtcgttggatcggttgcgagcccggtggtgacaaagccctttggaactgctgagccatccgctaagacgtccgtgacaagctggtgccggtcgatagttaaggacatcgcttgccggagcttggcattagctagcgcgggcacctttttctgattaaactcgagatagttcaggcgggatgtcttacggagtactaacttgggattgttcttttcgtttttgacttgttcaccgctcagggtggccatgtcgagcttgttgctctggaacaagttgaatccggtcgtggttgacttaacgacttggtcattgatcttttctaagtaaacgtgttttttatcccaatatttaggattacggttcagtgcccatgtcgtattcgtgcctttccagcccttcatggtaaacggcccatcgtagaccattttggcggccgttgtcccgtagtccttgccgtatttctgtacggcgtgttggttctgcgggaagaagatggcaaagcccattaggagtttaaaataggccatgggtttgtcaagcgtcacggttaacttgtatttaccatcagccttgattcctaagctagtggctttagctttaccattggtgatttggtcagcattcttgatgccagaataaagataggcatattgcgaagcggtcttgggatcgatggttcgccgccaactatacacgaaatcctgagcggtcacgggatcaccgttgctccactgggcatctttgcgcaatgtgaacgtataagtctttttatctttggaaataacggtatgggtcgcaatacccggtgtgattttattattattgccaatacggtagaggccttccatcgtgttattgatcatattggcactgatcgaatcggtgactagcgaagtatccaaggtcgttagttcggagccattttctgaccagttcaagacttgtttttgcgccatccccgcgcgtaagtttcccgcattatctgatttggactggccttgactacaggcagctaataaaaggccggtcgatgcgaccgcagtagcagttgtcaacattactttccatttcatagtaaaacttccccccaacttgaatggtcacgaggatacattaaaggggaattaaaatcaatgtttcgattctaataattaaggaaattaacagaaacaaaatgtgtcaatgaacacaaaaaaggtaccgtagtctgtggctacgatacctattattgtgagatttaaggttagtttagcatgaagttatgccagttaggtcaccttatttggccatataggcactcttgaagttatagttaatgcccgccgtgttgtagactaggcctttcagcttggggttgaccatctgtgcgatgacattttgtgagagcggtgcgaccccttgatcagtcgcaatcgttttttcagcggttgcaagggcttgccaacgcttcgttgtactagtcgtactatttgcggtgctgatggcactgtcgaaggtcttgttggtccacttaccaaagttgtaatcgttagttgaggtcatgataccgaggtccgagaccggatcggcaaagtcggcttgccatgcggagatgaccagctggaagttacctgcaatttctcgagaaattctcgtcttgtaaggaacggtgaggctttgaactttaagtcctggcaattccttttccagttgtccctgaacatattcagcaagggccttcatctgatccgtgtcgtcatgagttaacgttaaggtaactgacttcttgccggtttcttttagcccttgtttccagagctttttagctttggcgttgtcctgagtaacagctgatttgaccgtatttgcggtggcaaagtctttaccggtcgttggatcagtagcaagtccggtcgtaacaaagccctttggagtgacggaaccatccccgagaacatcgttgaccaactgcttacgattcaaagtcagtgacatggcttggcgaatcttcttattagcgaggaacttaactttcttttgattaaattccaagtaatttagacgtgaagacttccggatgaccaacttgctattattcttttcgttcttaacctgttgtccagataacgttgccatgtcgagcttattactctggaagaggttaaaggctgtcgtcgtcgacttcacaacttggtccttgatcttagttaggtaaacgtgctttttatcccagtaattaggattgcgcttaagggtccaagtcgagttagtccctttccaaccagtcatcttgaacggtccgttgtaaaccatcttgctggaactggtcccgtagtccttgccgtatttttcaaccgcgtgctggttttgcgggaagaagaccacgaaacccatcaataatttgaaatactgcatgggcttttcgagcttgacggtcagcttatacttaccatcggccttgatgcccaaggtactagtcttggccttgccgctgacgattttatccgcatttttgatgccggaatataagtaggcatactgagaagccgtcttcggattaaccgtacgccgccagccatatacgaaatcctgcgctgttacttgatcgccattactccatttggcattcttgcgcagggtaaaagtataagtctttttatctttggacacggtcgttttagtcgcaataccgggcgtgactttactgtttttacttaatcgatacaaaccttcttgcgaattactgatcatcgtcccactgataacatcagtggctaaggacgggtcaagggtggtcaaatcctggccgttttccgaccaattgaggacttgagtcttggccatgttggccgttgtgttgccggcattgcttgaactggatgaggactgaccacagccgacgagtaaaacgccagtcgttgccgttaacgtggcaactgtggcaaataatttccattgcatatatgtaccccctgcttcaaatgattatgatatgtagatgagaatacattaaaattagattaaatacaatattatttttttaatcattaatattattaagcaaataaagccagtacgactcgttaagaatcgtactggcttaattaagaaaactaacgttgccattgcatcgtatattctggttgctgggttgcttggtcactagcctgatcaatgacgcggaacccgtggtggtgataaaagacgatggctgggcgattagcaacatagacgtttaattgtaattgatgatggtcagcttgggcagtcgccaatagcgccgtccccagaccttgatgttgagcatcattgcaaatgaaaattccggcaatgtaatcgttttgtaagcctataaagcccagaatataagcttcaggtccgtcggtcagtccgacgatgagttcggctgattgtaatgcttcacgtactaagggggcttgttgacgccagtagtcggcactgacaaagtcatgggccgttaaattaccacttaaccagattgccattagctgatcgagttggtgagttgtcgggtgttgtaagtgttcaagcttcattcgacgttaccctgttttagtaggcgaacgcgactcactgctggaattttagaaagttcagctattaggtcagcttgttgtggctgctgtaggtcgtcgatgtcaatgatggtgtaagcggtttggtgtttagcagcgttggccatagtggtgatgttgaggttggctgccgctagtttagccgtgatttggctgaccatgttaggcacgttttcgtgaatgattgtaaagcggtaagtcgcgttgaacggcacacttaagtctggcagattgacggccgcatgaacgttaccggtttccaagtaagtcatgatggtacgcgcagcctgcgtggcaccgttgatctcagcctcgatagttgagccgccgatatgaggtgtcacggtaaccgcgggctggtcggcaagctggggttcgccaaaatcggtgtagtagtgggcaacttgtcccgtggctaacgcattcatgatggcagtattgtcgacgatgcccagccgcgaataattaaataattgaacgcccgttggcatggcggccaacgcatctttattaatcagatgaagtgtgtcggcatttttaggcacgtggacggtgacaaaatcagcttgtttgaccgcatctggtagcgtggccgcacgctggacttgtttggcaatgttccaagcggcatccgcggatagataggggtcgtaaccaatcacgttcatgcctagattcaacgccgcattggctacgagcgcgccaacatggccgagcccaataacagccaaggtcttacccgttaattcgacaccgttaaattgcgtcttgtcgtgttcggtacgttgagaaatgtcagcttcggtatgttgggctgaataggtcgtcgcagcgattagattacgggatgccataatgagcaggccgatgatgagttccttaacggcattagcgttacttcccggggtgttgaaaacagcagtcccgttagcggttgcttgatcgataggaatattgttaacaccggcaccggcgcgcacaatgactttcaatgaagatggtagtgtctcggtatgtaggttgaccgagcgaattaagtaagcatcaggatgctcagattgattgagcgtgtaatcggcagtaaacgtgttaaggccggctggggcgatggcgttataggttttaacttgatacataaatatcctccttgattaacgatgatgtgcttcaaaagcggccagatagtcaactagtgcctgaacaccggctaacggcatggcgttatagagactagcacgcataccgccaactaagcggtgtccctttaggtttaataatccgtgctcacgggcaccttgaatgactgcagcatcgaggtcggcctggcccgtgacgaatggaacgttcatggtcgaacggtcgctggtcttgaccggattagtaaagagttgggactggtctaagaagtcatagagtaaggcggctttagcgtgattgcgagcagtcattacgttgagtccgccctgggcctttaaccatttgagtacgagacccgcggcgtaaatggcaaaaacgggtggcgtgttgaacatcgaatttttatccgcaaatagctggtaatccagcatacttggcaggttggcgacttgaccaattaaatcatcacggacaatgacgattgtcaaaccagcgggacccagattcttctgagcaccagcaaagatgagtccaaaatcgctgacttggtaaggttcacccaaaaagtttgatgacatgtcggctaccagtggtacttgacccgtagccggtaagcgcgtcatcatggtcccttcaatggtattattagtcgtaagatgaatataatcgagggattgatcgatgggctggacgaccgttggcagttggttaaaatggttagcagcgctactccccagaatcgtgactttagtaccgacccgtttggcttcatcggcggcgcgttgtgcccagtgaccgctgtcaagcaacccgatacgatgatggggcgccagatttagtggtgcggctgtgaactgtagcgtgcccccgccttgaaagaagagtacgtgatagttgtcagggatagccattaaatcgcgaagatcttgttcggcatcttgaaggacttgcgcaaataaatcggagcggtgtgagatctccaaaatgctcatgccggagccttgaaatgagggtagctccgcttgaatttgagtgatgactggttgtggtagaacggctggcccagcagaaaaattataaattggcatgaaaaatcctcgctttcagtagtttaatcagggtaataaaaaagtcctggcagtcggttgcgactaccaggacggataataacgagattaagcaattccacctggtagcgaatgtcttagcatccgtgctcaggctgatttgcgtacgcaaaattaggccgacacagatgggtgtgtagaccaggaggaactgatatgatgattgataggattagttagaaccatcagttggacactccttcgttaaaccggtgttggcaccagtcggttaattgcgttggtattaatttagcaagcacgggtctatttgtcaagctggataatgagaaagaactgtgacaaaattagtgtaactaataataatttaatcttggaggcgcacgatgacaaccttttacgtggtacgacatggacaaacaacggctaacgcacaaaatttaaaacagggcacgattaatacagccgtcacgcatttgaactcggttggcaagcagcaagcgcaaacgttgcacgatgcatttgatattagcttcgcggaccggttgatttgtagcccgctggaccggaccaaggcgacggcggcgattttgaatcaaggccgacagctgcctgtcagccaggacgaacgattattggaaatttcatacggccagtgggatggacaggataatgaccagctgctagcggcctatccgcagtactttgatccacttttgcaggacgttttgccaagctacgtggaggttgcgacggatggtgagacttttgaacacgtgcaacaacgggtagccgcattcttgaaggccacggcacaagcccatccagacgagcagattgttgtcgtgacccatggctttaccgtcaaagcgatggccttagcgatcctaaagccgaccgatccgatgagcctaccggaaccggctaatacgagcgtcaccaaagtagtggtggatgctgtccatgaccgccaatatttagcatattataaccgcttgccccaattctgacgcgcaatgacttaacgaacgggcgattccgggctacaatagatgatggtttgaaataaccacgcactgttgaaccttatttcaaatcaaggtctaatcaggcaacaacagcagacatcacatataaactcctaagtgaggtggtcctggcatttggcgaggatcgcctttttgtatccgcttaagcgtttgaacagtaccaatattacaggcgcggtataatataaatagtattcaaaaattagatgaggtgagtaatgatgacatattcagcagcatcaacgcgctatgacgaactaccgattcgacgcgtgggtaagacggggctacaattacccgttatctcgttggggctatggcggaattttggggatgaagcgccgtttgctaattcacgaaaagtggttctggatgcctttgatcatggcgtttttagctttgatttagccaataattatggaccatcgaagggatcggcagagcggacgttcggacaaattatgcaacgagacttaaagccgtatcgtgatgagctcgtcatcacgaccaaagccggatatccggcctggccagggccgtatggggctttcggctcacgcaagacgttgatcagttcattggaccgtagtcttaaacagatgcatttggattacgttgatattttctactcacatcgtccagaccctaacatcgatttgtatgagactgccgcggcccttgaccagttggttcgtcaggggaaggcgctgtatgttggaatttcaaattatgaccgcgaccaaacggcaacgatggtgaagtatttcaatgagatgcacacgccgtttacagtcaatcagtactcatataacatgttgaatcaacaggctcaaacaaccggcttgattgactatctcggccagcataatgcgggcttagtggcatatggtccattagctgaaggattattgacgcagcgttacttacaaggaattccagccgattttccgattcatcgaacgaataaatatttatttgatcaggggaccgcaaccgtggttaatcaattgaatgccctgaacagaatcgctgagcaacggggacaaaccttggcccaaatggctttggcttggctactacggtcgcaggtcgtcacgagcgtcatcattggcacgaccaatgtcgaccacttgcacgctaatcttgaagcaacgcacaatttaacctttagtgatgacgaagtaaaagccattaccgcgattctaaagtaaatcgcattaaaggccactcccccaatatgccggggagtggcctttttagcacgtcctgtttattaaggtcaaaaatagctcgcgcttaggctcgttaggtagacgcctgttcggcagcaatgctcgccctatttccgtcctccggggctgggggaccattgcggaaacgtaaaccgagatcgatttgagcccaaacccgcccagtctcaaatacgagacttattctaagctggcggcttttgaacttaatgacggtcatgttttgaactgaatcataaccgtgcgctaacttcaactgaccgaatccgggtaattttaaaataatctgggcgaatgttcggtaacctcggtagttaatggtgtaattagttatcctgtgaaattactgattggtacaagtgaccggtttatcaacgtcatcaaaatgtaatagtttttatcgaacgtacgttctgaagatgtgctatgatggagctactatttcgatgaggtgatctaatggaacagctgaaaccaattgaagcgtcgttattgcaagcttatgagttaaactgcgtggttcggttaactttaagcgatggtcatcaaccgagtggcttaattgcggctgtggacgaccagcagctttttttgaatcagcaagcgggagtcgttaagccgattgcgttgagtgatgtaaccgccattgattttcttaaacagtcttggtggcagcggtaatcctaaaggtcgtatttcactatgatttcgtgacgacggaattcggtaatagcagtaatcaattcaagtggtaggggctgatccagcggaaactggatggcccctttgcttgttttataggtgactaattgatcatgaaaagcctcaattgcacttggcgttgggtacaagccaaagtgatgtttgaataaagcaaaatggatgacgttttcgtgccaatagaaggtcggcatctggtactttaactgttcttgcgcctctggtaagaccgttgcaatggtttgctgtaaggctattaattgcgattgataggcttgtggtgtgttagcaatataggcctcaatcggcgtcatggtgaatatcctcctggtcacgtaattcagcggctaaagtggcatcagggacaacggtgatcgtgcgtgcagtaccactaaaggtaacgagcccggccttagcacccttgggtttacgcatctgaccaacggtgagcacatcaacaggtacgcggttcatctgacgacccttactgtaataggccgttagtacggccgcttcctgcaaggtttgttcactcggatgattactgtgaataaccacgtgtgaaccgggaatttcaccacccgcgtgcatccagtagtaatctttacgggccgtcaatgttaggtggtcgttttgacgactatttttaccaacttcaaccagcacgtggtcgtgcgtgtaaaagcggcggggatgggcgggtgttggggccttagatgagtgtaaaacgtgggtatgaatcgcgcccgcagcaatcagtgattgtttaagagtggccaccgcttcgggattctcagggtcaaaggctgcttgagtcgctaattgctggtgtagttcggtcttggccgtcgccaaattttgttgaacggtcgcttgaccgcgtttgcttttgtgataacgatgaaaataatcctcggcattttcaataattgattttttaatatcgagtttaatactaagtgggtggccttgatagtcgggcaattcgacgaaatgatggtgcccttcgatctggctagcatacgtcttcaataacgtgcccttgagttgcaactcactgacatcaggtaggtggtctaatgctttagttaatgattcgatttgtttacgcgtgtggtgaattaagtgcgctaatccagtttggactaggtcgacatcggttgtggtcgtcatgaattgggttcctctaatctgtaaaagttaacaccttaataataacatgttctggttagttaacagtggaagattgggactagcgcatgaattaagatgtcaaatgacgcgattgaaaaaagttgagcaattttcagaaaagttcggtattctattacatgggagttgattgagaaatgcaaaaaacattaattattaacgcaggtagttcatcattgaaatggcaattatttgccatgcctgctgaaacggtggttgctagtggtctcgttgaacggattagtatgcccggttcaattttcaccatcaagtatggtgaccatcaaaagtttgaaacgacagtcgataatttagatcaaaaccatgcggcgcagatgttattagctgaattacagcgattagcaattattgactcattaacggaaattacggcagttgctcaccgagtcgttgcgggtggcgaaacgttcaagcaagcagttgaagtgacgccagcggtactcgaagccattaaggggcttagtgactttgcaccattgcataatccgatggaggcacgtggtattgagacgatggcgcaggctttaccagctgttaaacagtacgcggtatttgatagtcagttctttaccgatttaccagaaatgaatgcaatttacagtttgccttatgaattgacccaaaaataccatattcgccgttacggtgaacatggtatctcgcatggttacttaaccgggcgggctgcagaactgctggctaagccgaaagatgacctcaacttggtgacgttacacttaggtagtggcgcgtcattagctgccgtcaaaaatggccgggctttcgacacatcgatgggttttacgccattaacgggtgtcacaatgggaacgcgcgcgggtgacgttgatccggccgtattgccatttcttatgaaagctttaaagatcgatgatccgaatgaaatcatgatgatgcttaacaatcagtctggattgttaggaatctcaggaatttcaccagatatgcgtgaaatccgtgcgcaagaagccacgaatccccaagcccaactagctgttgaaatttttgtcaatcggattgttaagtatgccggtagctatttgacagaattaaaacgggcggatgcgctgatttttgcgggcggcattggcgagcataatgcgaccttgcgccagcaaattattgatgaactgagcatctttggtgtgaccctggatccgaaattaaatgaagcgggtcaagaaggactcatcagtggcgcagattccaagattaaagtgatgttgatcccaactaacgaagaattagcgatggtgcgacaagttgcggcgttgcaaaattaagcttctcttaatttacgactgcaatcagtctgccgctgtatagcgcgtgctatactaactggcaaggtacccatgatgggacttgtaaggagggaagctctcttcgcagagcgcatagatgatcggtttattgattgctttagtaattggtttatggttgctcaaagttatctttaaaattggttttaaaattatcggttgggtgttcatgattgtgattgggttgtttttatttaaaatcgcattatggttaggcctgatcgtcgtggcgattgccggcgttgcattattcggaaatgccaccacgtaatttgaaagataaagatgagcgttgttaaaactagtgttatcggcacgctagccgtaaaggcggcttgttggaactaaatagtcattgaacgaaaccaggaaatctcagttagttttgtgagacttcctggtttttgagttagattaaagttccgagataaaccatgactaggccaccgacgagactcaagccaaagtattcccaggcgacccgttgatggtggttacggccgagcaacacgagttcgttgatcattgttgaaaaagtcgtatagccacccataatcccagttcctagaaaaatctgccagttgggcggtaatgagctggttaaaatccaaccgagcaataaagcgccgcttagattgataaataacgtggcaattggtaacggccatcgattgagaggtcgtgctaagcgcatgatgccgtaacgacttaaggcccctaaagctgcgccaacaccggccaatccgactaggactaacattaaaattcctcctttggtagccaataggtgctaaggaagtttccagctagacccgccagcaagcccaaccctaagctagcagcgacataacttaaagctaaaacgctatggccactttggaatgattgtagcgtttcaaaagtgaaggtggaaaaagtagtaaagctaccaacgagcccgacactcataccagtgacaatatcttcagagacgggtaaccgcgccggtaacaagttagtaatcaggctaagcacaaatgcgcccacaatattaatcagacacgttatccagaaatgttgtggccaagtgacgagcaaactaagcccctcccggagaccaccacctagcattgcgaagccggtaatggcaatcatctttttcaaatggacacctgctttctgaaagtaatttcagtttactgaaaaagttttgaaaaaacaacaacccttgcaaatcaaaattaaacatgctaatctacaagataacttataaaacacgaggtattcagccaatgcgcaactaattaattctagtaactgaacaggaaccatgcctagcaataggggtggactgtccgttttgggattaattagggtgctggtggaatcaattgccagcgttctcattttgaggacgcttttttgtgccataaattagtccctgcaactaaggggatgcttattaatgacaatgattaatttaaaaaatattcaaaaagatatggcgggacggccactattttcaattgaccggctagtcgccaatgccggggataaaatcggcgtggtggggcgaaacggtgctggtaaatcaacactggcccatttactaacgggtactgatcgtgattatacggggcaaattatggtggacgagccagtcagctatgttgcccaaatcgcaccgacttttgaccaaagtggtggtcaagctatgctaaccagaattcggcaggctttgagcgcccacccaacaattttgattctagatgagccgtcatctaatttggatgaatcacatcagcaatggcttattaatcagttacaacgttttcgcgggttgctgctgttgatttcacatgatcggcaattattaaatgctgtgacgacacagacttgggcggttgaacaccaaaaatttaccgcatatgccggcaattacgcatattatcagacggtaaaagcgcagcaactcgcaactcaggaagctgcgtatcagcgccaaaacactcatcagcgtgagttactagcagcgcagcgtcaacgtaacgaaaaagcccagcggattcgaaaaggtaatcggcgaatgtcgcaagtagagcgtgccaagacgaaagcgactagggaagctaccgcggccaagatggaacgaacggctaaacgcatggtcgcccgaggacaacgggaaccgcaagttgctaagccctttacgacttcaggctttaagttagtcgcgacagattttccgacgtttacaggtaagaccgtggtaactggtcttaatgtcacattggctgaatatggaaaaacgttgttagcacacgctgactttcaaatcaggccacatgatcgggtcgctatcgtggggcccaacggtagcggtaagaccacattactgcgtgcaattttaggtggccgggtgtcaggattacgattggcaccggcggcacgagtcggagtattcaaccaagatatgacagtgctcgatggtaaacagtcggtgtggcaaacagtgcggcaagtcagtcagctaccggatcaaacgatccgcaacgtcatgggcgcgctgggcctgccagcacgcttttatccgcaactggtatcggcgttaagtggtggtgaactggttaaattacagctagttcgtattttagtcggtcaatataacgtgttaatgttagatgaaccaaccaattatttggatgtggacgcgctggatgcgttggccgattacttacaaaattatcctggaacgataatttttgtttcacatgatgaaccgtttcgtcgggccgttgctactcgggtgttgcaattcgagacgcaccaattagttgatcctgacaaagttgttaaagcgccgcaaccagtggaaactgacttagcagtacttcagttcaagtatgatcaattaatggcggacccgacgtcttctacagctgatattcaggcattacagcaacaaattgatcggctgaaagcatgaattaaggtcaacttgttgttagtttgtccgatctgagtggggaatattacccaaaaacaggttttctcatcattgagaaaacctgttttaatttagtgtttatttagttgcatgctgctagctagcgccacggaatgacgaaagcgccgacttgtaaaagcaagacgccgctaatcacaatggtccaatccaacttagtcagtggaatttgacgatagtgggtgcggggtgcatcttcgacaaaaccatgggagcgcatggcctgggcaaggttctgcgaccaattgatagagaccaaaattgctttaaagtagagctgtggtgaccagaaggacaggacctgcccacgcatcaggccagcagcccgaatcacttgaacttcgtgctgaatccgtggtaccaagttatacgcggcgaggacgccatatgcaaatttggcgggtaaatgccagttttgctcaagcgaatcggttaattgtaagacgtcagtcgtgagcgtaaaagtagcgcccgtaaaaacaaacgcatagattcgtgtgaacaggacccaggccatcaaagtcttgtcaccgctaccgttaatgtactgggtactccaaagtccaattgctggtatcaacggaatgagtagcaaccaccctaatgttcgaagccgcgttcggtgaccgagcaggtaaatcagtgccagaataatcagagctacgttcaaacttacaattgtcgtgaatgaaatttcgagcgcaatgatgagtagtaataataatttcatgctaggattcatgatcgcaccacccaatctaaatggtgattttcaaagtgtagctgatagtcaatcaatggcatcaggccggttaactggtgactaataataatcagtgtctgcttagttgccgcttgggtggtctgtaataacgcgaccagggcattgatcgaatgcaaatccagcccttttaagggttcatccatgagtagcactggtgactgcatgattaacatgagcagaatttgtagtttctttttctgtccctcactcaaagtatagatgacttgttcatcacgcccggataagttgagttgcattaaggccgtttgaatacggtccgcggtaaagtagtcgccatacgcatagcgtttgctttgagccagttcttcagcgaccgtgatgtttaaaaactgggtctcagcgtcctgaaaaagcaaggcgacgtggcgagcgtagcgtttgcgttttagcttgtcgataggtgtcccttcgtaacgaatttcgccagtataggggtgcagacggacgagggcttcaaataatgtggatttaccgctaccgttaggacccgtgatcagcgtattgtgttgtgctaacaattgacgcgttgtcggtactaatagttgacgatcacctgcctgtaaagtgacgtgatcaagttgaaaacaagggcgttcaacgcgttgcggtgctgaccatgaccgttgtggctgctcagtaaaggctgcaaataactcagaccaggtggtgcgatcaatgagctgtaagtgctggtccttgatttggacgacttgatcgacgagctgttcgtaacctgataggtcatgatccgccaagatgattgtcttcccatgttgattgcgtagttccacgagtcggtctaacaagacggctcgtgcggtcggatcgacactggcaaagggctcatctagtaggatgacatcgctatccatagcgacaatgattgcaagggccactttctgtttctcgccaccggataaatgatttaatagtcgtgactgtaaatttcggataccaacaaagtcaagcgcactaagtaagcgggccggtatttggtcacggggcacttgtaagttctcaagtgcgaaaattagttcattttcaacggtatccatggcaaactgctgattaggattctgaaacatcatggcaacgtgctgagcacgctgattagcggtgctagcagttaatgactgaccatcaaaggtaatggtgccgtaatctggagtcaggggtagtaagcctgcaatcagctttaggagcgtcgacttacctgttcccgatggccctgtcaataggatgaagctttgccgtggtagtgttaggttaacgcgatccagaatgggtgtcgacgcctgtggataggtgtaagttaaattattcagcgcgatactagccattcgagaaagcctccattttataaagtgtattaatgcgttgattttaaaacatgactgcgatcaagtaggtccgtgatggttttagttaacagacccccgaaaacaaacatcgaaataaagcgaacgaccacgtataaaaccaagagccacagctgtaatttatagtaaccattacgggcaaggtcccagccaaaggtgaccacagtagttgttgcggccgcagccgttaagcctaaccagtcatagtgtttgtagccagtgacgatataacctagttcggccccaaatccttgcacgacaccagaaatcaatgtggtgattccccattgaccaccgaaaaacatttcgacggttgctgcgaggagctcacctagcgttgccgaaccctttagtcgaatgaggtagccagctaacatgccgggcatgcaccataagccaagtagtagttcattagccagaccgcttagaccaaatggtgtcagggccgcacttaaaatgttataaacaaaattagtccccataaagatggcaccaaagaaaataccaattagtgccagtaaaataatatcgttcaagtaccatgatttaacccatttcattgttaaatcctcccaaaagtagtttgtcattcacgcatccaagcgacaaaaaacgcctaccacgattatcggtggcaggcggctaagtctgaattgatggttccccaaataaaagcattgctccctgcgctggcattgtccagattcaggttcaatgggtattatctcagccgtgatggcaccccagttgctatgaatgatacgtttagtgtaacggataatgacattcagtgcaatcaattttccggaaactaaagcaaagtatgatgaaaagtcacaattttgtggtttactatggataaagcaatgtatttggttaatattcttaggagggatctcgatggcagaatcagtgtatgattttacagaaactgagatgagtggtgcgccgcttgacttgtcacaatatcgcggtcaggtcttgctaatcgtgaatacggctagcaactgtggcctggcaccacagtttaaaggattagaagaactttatcagaagtatcagcaggagggcctagtggtcttgggattgccatccaatcaatttcatcaagaaaaggcggatgacgatgagacccatgactattgtcaacggcactacggggtaacgttccccatgaccaaacgggtgatggttaatggtgatgacgctgatccgttatttacttacctcaaacaggcggcgggacatggccgaatcaagtggaatttcacaaaattcctgattggtcgtgatggccgtgtgctcgaacgctatgccccaacgacccggccggcaacatttgaagcagcgattcgtgatgccttggctgatcgttcagaagattaacgataaatttaaaaatgattgtttaatttaaaagaaagaagtggcttaagttggaaacttatacgttacgtgatggtttaacggtacctaaaattggctttggaacatataaactgaatggtgctcatggtgtgcaagtgatcgactcagcgattgatcgcggctaccgattattagatacggcctttaactatgaaaatgaaggggctgttggtgaagcggttcggcgttcatcagtaccgcgttcggaactcttgatttcatcaaaacttcctggtcgtcaccacacctacgcggaagctatcaatacgattcaagaatcattatatcgagctggcctggattattatgatttatatttgattcattggcctaatcctaaggaggatcattatgttgaagcttggcaggcgctgattgatgcccagaagttaggcttgattcgttcgattggggtctcgaatttcttaccagaacatttagaacgattaaacaaagaaacgggtgttttacccgtcattaatcaggtcgaattacatccgtactttaaccagcaggcacaacgggattatgatcaagcacatggtattttgacgcaagattggagtccccttggccgggccagtgagatgcttcaaaatgagacgctcaaagagattgcagcgcactaccataaaaacgttgggcagttgattttacggtgggaactacagttagggactttgccgattccaaagtcgtcaacgccgagccgtcaagccggtaatatggacgtgtttgattttgaaatcagtgcagctgatatggcaacaattaatggtttgagccaagtggatggtcgcttgaataatcaagatccagcagtgtaccaggaattttaatatgaatgatataaaaagatagcgacgttgtgatgataactcgtcgctatctttttatggacaactacttgttgatgattggtttgtgatatcagcgtaatcgcaatacatggtgcagtagcggttggctgttttcatcttgaaaggtcgtggtagtatgacaaatacgtttcccacactaagaaaggttttcagccgtggtcactctacctgtttggtttgctttcttgcaaatcattttgagcattgcactagcgatgtatcaggtatggaactccagaaacaaaaatagccaccccaaaactttggctggtattgggtgactgttctttgattatctaaatttaaagccaactgctcttagagcgggccttgattcaagtcggtattaacgtaccggcttttttactgccgttattttaacacgtatacgcttcagaaagtgtatttttgattcaaaaaaataaagataagcttccaatcgattggcctaactattttattacgcgcgcttaaccgcgattaccttaacttgataagccccgttcggtgcgttcacagtgaccacatcgtcaacagtatgattagcgagtgcttgaccgatgggagatgtgaatgagattttttgttgttcgagattggcttcctgttttccaactaattgataggtgatttggtcatgatcatccagaaattcgatggtcacgaatttaccgatatcgagttgattgttgtcagctggttgaacgatttgggcgtattgcaactgcttgttgagataacgcaggcggctttctaagcgacctaagtcccgtttggcactactatattcggcattctcagaacggtcacctaatgccgcagccgcagccagaattctgattcgctcgggccgttgttgctttaagtcttcaatttcctgttcgatggcatggtaaccagtcgaagtcattttgttaaaagttggttccatagcaaaaacctcgtgtccgttgaatttctgggaatagtgtaccgcaaatgtgattagaatggtaccgtctaggtgatatctgatgttaatcacgatcgcgcaggtggttgctatacagcatgataccgctagtgacggtggtcagggcgataccagcgatcagactaatgaacggctgatttatcgcaatcaggaagtagaatagggcggtgaaaccgattagttcaatgagtgcccacaggccaaggtagcgccatgaccgtttgggtttgtcttctattggggtgctgacattaacagacaaaatgatcatggtaaaaacggcaatcatcaggacaatatacaacggattgtcgtacgtaaaggctttctgaagattgtttttttgccagccttgccaaaataaaatcagtaagatagcactattttcaattaacaacgtggtacggatgttcttgaaattttgtaaaattaaacgttcgtcacgaatctttttcatggcagggatctcctaactgggttcgacccaaaagacagtatcgagtgtttggttgagtgcgtgacagaggttgaggcagagtttcagtgatgggttataggtgtccttttcaatcaaactcagggtttgacgggtgatgccagtcttgctggcgagttctttttgtgagaatccagccattaaccggtattgcttgacatgattcgcggttaacatctccctttatgtaatatatatcttccatacaaagctaattttagcagttaccaattgcaatgtaaatgttggatagtttgattgaaatgtgaacaaataaatggttggcgtagaggtatgagcgcaaaaaaatagccaatgactttgcagccttggctagtcgtggaatttctcacgttccacggagttacgaacatgttaagtataggcaaaattatcgaaaaatacaattaatttattaaaggagtttggcttgacagtttaacaatgataacgattgcaaaaaataaaagtgaaatatttcagacaaacctcttgaattttagtctagaccaatatacaattggactataccaaacaaagagggagtcagttaattatgaaagttatcgtagtaaaggatcaagctgccggcggaaaagaaggtttcaaagtatttaagaatgctttagacaatggtgcgaaagtatttgggttggcaactggttcgacacccgttacaacttacaaagaaatcgttaatagtgacttagatttcagtgactgcacatccgttaacttggatgaatacgttgggattgcaccagacaacgaccaaagttataaatacttcatgcaaactcatttattcaatgacaagccatttaaggaatcattcttgccaaacggtttagcttcagatccagaagctgaagttaagcgttacgacaaagtgattgacgaacacccaattgacttacaaatcttagggattggccgtaatggtcacattggttttaacgaaccaggtactcctcgcgatattacgacgcacgtggttgatttaactgaatcaacgattgaagctaacgcgcggttcttcgccagcgaaaatgatgttcctaagcaagccttctcaatgggcttagcttccatcatgaagagcaagcacttattgctcgaagcattcggcgaaaacaaggctgatgcggtcaagggtatgattgaaggcccagatacccctgaattaccagcaagtatcttgcaaaaccatccagacgttaccgttatcattgacgaagcggctgctagcaagttaagcaagaagtattaattttaattaagttaaaaatgaactgaaagccgtgcttcataacgattgcgttgtgaagcacggctttttaataagtactcatgtaaagtaaaaaatgattcgactactaggatagttagcagttgaatcatttttggcttattcatagattttgtcctttttcccaagttgttttcgataacaacagcccttgcttaaccaaagtatcaaacaacgcatgggtccgtttggaaacttcagcggcagtttcggcgttggcattcgtcaaaaagtcggtcgcgttaccagtgatggccgcgtcggttgcggcaacccggccacgggcatatgattggcacccgtcgcgataggcattgaccgtttcagcaaattcatgccagtgtggttcaatcaagacggagagcgtttttgataaccagtagacgttatcaacgctgaccgtgctagttgtattgcgataatcaatcggcgtgtcattgatgttggtaaagaagggcacgtatggggcgtaagcgaagaaacctagtgcgatccattgaatggcggcttgcttagcaggcacgtcattccggatttgcagaatagatgagcactgattgcgatccatcgcgatagaccggtaacgtgtttgttcacgggcgttaccagaagcgaaagtgccaaatggatcgtaaggcgtcccgttatagtgtgaagataagaagaactggacgtcttcaatagccaattttttgcttggttgtcggaatagcggcatgttttgatcagtgggattctgttcgatttcgggattaaatagtttttgaccataccatgtccgcggagtgttgtaataagcatccgcttcactttgggtaccgaagatttcgcggaaattaaagtgaccgggtgttgggttgaggtgatacttttcaacgaagtccaccaaatcactggcacctaggaaattgtcggtatcgttgagatccatctcttgcaccacggtttggttgggaacaattgcgtaggtgtcttcgggcatccgaactgctccccaatggtgaccaccagcggtttcgaacaaccagatatcgtcgtgatcgttaaaggcgatgctgttgctttcaccagttccgtatttttcaattagggcacctaagcgttggacaccttccttagcacttttaatgtaaggtaaaacgagggtgaccatggcttcttcatccacgccatcatggacgagcggatcgtaaccgagtacgcgggcattggtggcagtggtttcggttgcactcatcccgacatttaattcgttgatcccagcttcctcgtactgcccatcgctttgatcggcttggggggttgcggtgtagcggtaggcatggtcgggcagcggaacggtgacgccggtagttacggaagtgtagctggcgttagtttggtcgtgggcttcgtgcacaataaacttaatcggattaattgggccgtagccatcttcgttgcgggcaacgatggtcgaaccatccatgctagcagctttcccaactaatatttcggtacaatcagtgtcttttttcattacataggtcactccttagttaattataagtataggagcttgcggggggatttcaatgttaaatcgtattcataatcatttaaataagaaaatgatgagtgaattgcctggcgctttctacataaaatgctaaattcgattgtgaaaacgcaatcatatctaacgagataagtttaattagtttgctggtattgccgatataaaagcgcttattgttactgtgccaatttttaattttgtgaatcaatgagtttaattgtggcacagtttcctgtgccacgggtctaactagaagttcttgaaaccgcttaccatgatagatatgattaagttgttaagaaaaaggaaggagctttacctaatgagtgaaaatgtaaatacgaatgcaacccaaagcgctcctgttgcgaaaaagaaactgggcgttaaggcacgcgttcaaaaatttgggagtgcactgagtaatatggttatgccgaacatcggcgcctttattgcttggggcttaattaccgccatctttatggctggtggttggtggcctaatgctggattagctaagatgattcaaccaatggttcactatttattgccattattgatagcgtttactggtgggactttgtttgccggtcatcgtggtggggtcgttggtgcgattgccactatgggggtcatcgtcggttcttcaatcccaatgtttatcggtgccatgattatggggcctttaggcggttggtgcattaagaagtgggatgacgccatttccgataagattaagagcgggtttgaaatgttggttaacaacttctccgctgggattatcgggatgttactagcaatcctgggttactttgcaatcggcccattggttgctggtgcaagtgctgctatggctgccggtgttgactggatcattaagatgaagctattgccattagccaacgtcttcattgaaccagccaagattttattcttaaacaatgcgattaaccaaggtatcttaacaccgcttgggattcaggctgcatctagtgcgggtaagtcaattctgttcttgctcgaaccagatccaggtccaggtcttggggtcttattagcctttgccttgtttggtaaagggactgctaaggcttctgcacccagtgcgattattattcattttcttggtgggattcatgaaatttatttcccatacgtattaatgaagccagcattgttcctagctgttatcgctggtggggttactgggacagccacattcagtttactaaacgttggtttacgttcaacaccttcacctggttccattatttcattactattaatgtcaccaaagagtatttctaactacattggtttaattatcggggtaacgttagcaaccttagcatcatttatcgttgccgcaattgtcttgaaacgtgacaagtcgaccagtgatgatgacttagccgctgctcaaggtaaaatgagcgacatgaagagtggcaatgctgaagctgctagtgcgactgacgctgaaccagctgatgtgattgcttcatacaaagatgttgaccatattatttttgcctgtgatgccggaatgggatcatccgcaatgggggcttccttattacgggataaagtcaagaaggctggcattagcatgtccgtcaccaacacggcgattagcaatttgaaagacgaacctggtttattagtgattacgcaaaacgaattagctgatcgggcggctcaaaaggcaccacacgccttacggttagccgttgacaacttcttgagtagtccaaagtatgaccaagttgtggttaacttaaaggctcgtgatcaagttagcgatgctgcacctgcatccgcggcaccacaagcaacgacgactgcacccgacgacctaccagctaacttagatttgagtgttgttgatgaaattgtctttgttcaccacgatggtcatttaggaacagccacaatggcaacgtccttgatgaaggatcgggtcaagaaagccaacaagcatgtgagtgttaagaacttaggaattgacgaattggctgataataatagtttattagttgtttcaagtgcagaagcagctaaaaacttaaagacccgttacacgcaggtccaagtattaattactgacgatctattgagttcacctaaatatgataagatggtatcagaattgaaataaaatgatattattaccattatcgtatgaggtggcatcatggttaagtttacacaacgtcaagatgagttgctacagctgctactagcgaatcccgccggcctttcaatgagtcagattgaaaccggtctcaatagtagtcgccgaacaatttatcgcgagttcagtaatttggaattggtattagccaatgctgatttgaaaattgttaatgagaagcatcactttcaactaagtggatcacagacggccctggccaagtttcaaagccaattgacagcagagcggaagattgcaccggcgtttgactcacaaacgcggcaaaacgccctagcttgtcggttactgatgacgggccattccgtaaaattaaaagaacttgcgcttgactttgatgtgagcgttgcaacgatttcaaacgatttgacggcattagcaacgccattcgccgactacgacttatcaattgaacggttgaagtcccgggggattcaggtggcggggactgagggtagtattcgcaatctgtttgccaccattttgaataatgaaatcaacgactacgagttttttaaaacaatcgggaagttgaaccaaggcttagcaatatcagcaagtgatgagcaatcgtattttttgaacttactggacgcccaaacgttgattatctgttatcaagcagtgcgaagtttgaagaaaaagtacttttcttcggtgccggatggtcagctacaacagttgatcatcacgttgacgacgggagtaatgcggttacagcatgaacgtcgggtcacatatttgcgcgggatcaatcgggatgatttcttgaaataccaacggattgctctggcaattatgacccaactacccgctgagattaagacggtggtgacgggagctgaaattgattttctcgcccagcaaattaagggcttgacgtttcgaatcgatcaagacgcgtcgctatcgaattatgatttgcaactaacgtatcgggtcaaaaagtttattgacgcggttgcgactaactttaactggtcgtttgggacggatgaccgcttgttgaataacttgacggcacatatgcaaattgccctacaacgtaacggtgttaatggtcccgtgccgccaaccgctgagttacaagaggtccgtgaacagtatcctaagctgtattcggcggtggtgcgcggcttcgcaacgatttttaaagatcaggattttacaactgatgagttgacgtacttgttgatccactttgctagtacgtatgagcaacagttgagtcaccaagcactcaaggttttggtcctgtgcccgaatgggatgacgacggcgcgaatcttgaaaacgcggctgatgcggttagtacctgaaatcacagctatcgaggttgcacggattggtaatttaggccaagttaatttacaagactttgacatgattttatccacgacaacgttaccgggatttaagttgaattaccgcgttgtcagcccactgttactagaaaacgaagtcactgccttacgtgaatatattcatcagtattttccaagcaccaaagtgatcgattcaccggttgatgagccgacgaaaatcaacttggattttgacaccgtttaccaacagatgacgattgcgaaacagatcttagaccgtttcacgatcacgccgattcgcaacgatgatgagacggtggccgagacgctagttaagatcacgcggcatattgattcgaacttgattcatgatccgctagaagttgcgggccggttgttacaccgcttaggactggcaccggtcggtattcccaatacgaacttggcgttggtgcatacgttaagtcaggaagtcaccgcaccatattgtgcgattttcgaacttgaccagccattaccatttaagagtatggataaccaatcgattcggttgcagcgaatcgtcctaatgctcgggcccgccaatatcagcgattttgaaaatcggttgatgggtaagttaagcgcgctagtcattgaaagtcaggccaatacgcagacgtttatgactggcgatcgccagcaactttatcaattaattagtaaagcatttttgaacgaactaacgaaatagcgtaggtgaaaacaatggaagctttagataagaaaatgattgcgttgaaccagcaagtggctacgcaagaagaaggcatccgcttagccggtcaactattggtcgatggcggttgtgtcgaaccagaatacattgatgcaatgcaggctcgtaatcaggatgtctccgtatatatgggtaatttcattgccatcccccatggtactgaagatggcatgaagtatattaaaaagaccgggatttccgtggtccaagtaccaatgggtgtgagctggggtaatccagatgataacgatgatgataagactgtaacggttatcttcgggatcgctgggttgaacggtgaacacttgaacctcttgtctcagattgccatatactgcagcgacgttgccaacgttgccaagttagcggacgctcaatctgaagatgaaatcataaatctattaaaggaagttgattagcatgttagacgtacattttggcgcagggaatattggtcggggcttcattggcgaaaccttggctgacaacgggtttaagattactttcgttgatgttaacgatactttgattgacgaattaaacaaacggaatgggtataccattgaattggctgcagaaggtcaaaaacacattgaagttcacgatgttaaaggtattaacaacggtaaggatcctaaggcggttgctgaagaaattgcccaagccgatatggttacgactgcgattgggcctaagatcttgaagttcatcgcgccattaattgctgacgggttaaagttacggcaagctaacaacaatacgacaccaattgatatcattgcttgtgaaaacatgattggcgggagtcagtcattaaagaaatccgtttatgaatcattaaatgaagacgaacaagcttgggctgaccagaatgcaggcttccccaatgccgctgttgaccggatcgtaccgcttcaaaagcatgatgatccattgttcgtttcagttgaaccattcaaggaatgggttatcgacaagtctcagatgaagaaccctaagattcaattaaagggtgttgattatgctgacgacttggaaccatacattgaacggaaactcttctccgttaatactggtcatgccaccgtagcctatactggtaacatgaagggctacaagacgattggcgaagcagtcaaggatgacagtgtcgttgaccaagctaagcacgttttaggtgaaaccggcgacttgttgattcaaaagtggggctttgatcctgaagtgcaccatgcttatcaaaagaaaattttgagtcggtttgaaaacccatatatctctgatgatattgaacgggtcggccggacaccaattcggaaattaggtttcaacgaacgtttcattcgcccaattcgggaattgaaggaacgtggtcgcgattacagcgccttagttgatacagttggtgaaatgttcttcttcaactatcctaatgatagtgaaagtgttaagttacaacaattattgaaggatgaaccaatcgaacaagtcattcgcgaaacaactgacttgaaagatgaagatttagttaatgaaatcaaagctgcttacgaaaagcacttagctgcaacgaagtagttcgataaaaaaactaattactaaccgccatggtaattagctgcaaaaggcgcccagaaatttaattctgggcgccttttgcgtcttgcctgacaaagagtcacttgatagcagccatcgctgggcgagttaactggaacgatgaacgtgtaggtagcttatttttaagactggcagcacacgttaatttggatggtaggtaatgctaactgttgccctaccgaagtaagtctaatgagcaagtatgttgaccagcatacggctacttttcccagaaatgccaccaaggtttggccgcttgactggcttgttgatcgagttggtcaaggacttggtttaagcggtcactgagtgaatctaaacgccggatgatcatttcttgctgcttatagagctcagcattagtcgggccatctggtttggccgctggtgccattttgctggcatcgacggtggttgtcgtggtgaagggcgactttgtggtagttgcaggcgctggtttctcagattgcgtcgtcgttgccgccggttgtttgggtgtcgggaccttagcaccaaacgcgcgtcccagcgcagtggctaacgttgtgccttgttcggcgagttcgatggccgcctgaaaagtttttaaatcagcggctgtatataagcgatgactgttatcggccgggcggaagcgattttcatcgttaagttgtttttcaaccatggtgctatatttgcgcaacgtcacggctttaataccgagttgttcagcggcgacggaagcgactaattcagagtcctgttcgggactgattgtttgtgtggacacaaaaattcctcctttaggttatatcgtttctataacgctattatatcgaatttttgattggtagaacaccgatataccaagattttgtgacctatgtacgtgattcagacccggaagtcataattttgtgggaaaacatgctatgatagaacggaaatcaattggaaatgaggattagatatgatcgaaccagtcgataagacgacttttgcgacggtggctgatgataccgcgttaactgtggttgatttttgggcggattggtgtggcccttgcaagatgcaggaaccagtgcttgaagcgttagatgaactgtacgatgggcaagtgaaattcgcttcgctcgacgttgatcaacatcaggaaattgcgcaacaatttgagattatgagtattccggcgttagtgatattcaagaatggccagcccgctgaaaaggtggttggttttcatccccaagcagcgttgaagaaatatctggatcaaaaattagccgaagtgaagcctgcctaacgagcgttatttaacggtagctattgaagcaatgcataagtcaccccagaaacggttaccgcttctggggtgacttatttttttcggtgaagagtttacgcgtcatgacgtaattgataagctgcccatgtgctgaaaatggcaatgccaagaattgcgaggttaatgagaatcgtttctgtcagtggctgggttgatggggagaaataccattgttctagtaaaaaagtgtacaaaaacacgggtgcgtagaagaagcggagccatcgttgctggcggtgtaaccacaccagcgtaattcccgacaaccatatcagtactgatataacaaccgttgtcagtggactaactagcatcgtcagtgtggcgattatggctagcagatagggggttgtcataagtgggttcttgaatgagttcatcagtagtgcctccttattgaaaaagctaatgctcgtctaagtatatcgcgataatcaaaatgtttgtattgccatcataaaataaaatatttaaatagtgattttgacaataaatcagtttagctgtcaagttagaaatcgttaatagtttaaggggaagcgcaactagaaatggcgagttggtgcgactgccctattaataattaaattattaccggctttgccaatataattagctaagaccatgttaaattaagtagcgtaattatggtaaagtggggggctaatcattgaaaaaattgatttgggcattacgggtcggtatcgtcctctttggtgcttgtttggtgtgggaacaagtgcagcttgaacggcatacaagccagcgccggacctatcatcaacgtcggctgcagcgtagtaccgcagcaacgtttaaggcaatccgtcagccacaacttagtgattttccggcagctaaggtggaagccgcacaagtttggctacacctgaaggggactcgggtcatcaacgaggcaaccccgttacatatccgcaaaattgcggccggacagcgaattcagccagacgatccgcacagcgcggtctatcatcaccaaatgacccagatttatagtgatgatttacaagatgctactaatagtgtgatatacgcgcggaatgcggataataccgtattggttgcgcatagtcgttcggggcaacgctcgcaagtgggtccggtcgcccaaaatgttcacacagcaatgccagccgctcaaaagatgaagattccggctaaaccatccgcgacactgcttaaagtcgttcaactgatcatttaatatggttcaatttaaaaggctaacccacacggtgggttagcctttggtgcgtgatgctggccagttaatagtggtcatagagttgctcaattaagtcatcactattggtaatgagctggcgatttagtgaaatcaggtagtctggttgtgctgggtgaatggcgttgtagagtgtgtcttcaatgagacagccagtcagcgtgaatgaccgctgccggtcttgaacaatgatggtgaaggaacgcccacgactggttacgatgacattcagtcccattaagtgggttaggttcaagcctaacgttgcagttgaatcaattaatcctggtgtgccagtgcgtttgatcaagactaggcattcgtcaatccgtcgtagcgaattaaacatcgaaaatttactggtgttgcgcgggttcgatctgatagcccgtggccgccgtacgtatggtccaacgactatgttcataatgattcccccaaaccatttagttgattggtttaatcataactagtgcgaacgattagtgcgaaaatttcggcgcgggttggcagttagttgggccagtttacgggttagctttggaagctttactaacgttgtggcggcaaacatccagtgtatacaaattcgcaattactggacgcaatggcgttcaaaccattgatcagtaattgcgaattgcgtaatcgtgatgttaaaaatgaaactaggcttttactttactgtctgtttttcgtgctttgacggctaattcggggaaccaaattgcaatttcgtgatgcgcattttcacggctatctgaggtatggataatgtttcgtaaaataccgtctggatattcatgggagaaatccccccgaatcgtgccaggttgtgcttcggcaggccgggtgctaccagctaaacgatgcaccgctttgacgacgccagtaccacttacgataatggcgacgagtggaccttccatcatgtaggtctcgatttccttaaagtaaggcttgccaaccttctcactgtaatgttgttgaagttgttccgcggttgctttaataacctttaaggcggcaatttgataacccttgcgttctaaccgggtgataacctcaccaatgtgtccttcactgacaccatcgggtttaactaggaccaatgttttttcagaatttgccataatacgtgacctcctcgctttttgaaagcggtatcatttataacttaaattgtaggtgactttgaggggtacgtcaactagaatcgccgttttatcatgaaaattgcttgtaaattggcgtcagctggtcaataattgggacgcgagaagcgggttcaactagctgaattattttctatcgtcggaagatatcgctataataaaattagtaaatcataaaaggatttgatactcatgccaccacttgatttaactcatattcgacaacatcatacggttgctgaattaattgcgctaggaaaggcgcggcgccaagtcaccccatttgaaaaattagggacatttacaccagtgaaacgaaacgccagtgattatctgaaacatgtgcgggagatgctggtaccagaactattgccattgcggcgtgaacgaatgtctgcttcggcttttgcattcttccggggctcagtggagttaatggattatgatttggattaccagtcgtccactgaaatccccgccgtagtttgtggcgatgcccatattggtaactttggattctatgcgtcaccagaacggcgactggtctttgacttaaatgactttgacgaagctggcgtccatccgtgggaatgggatttacgtcggttattagtgagtgtgttgctagctgctcgtgattctaactttaaacccaaaaaggtcgaaaaattgatacaggcggcgagtgcgagttatcgggaagcgctcaaacggatgtttgatcagacgacgttagaccgtttttatcgcgataacgaagttcaggctgtcttgaacttcggtggtgctcccgaagatacggccgatctaattgcatccttggttaaaaaggctcaaaaacgtaattcagaacaagttgtgcgtaagtttacggtcactaatagtcgcggtgaacggcaatttaaggagaacgcgccccgttctgtccatattgatcggcaaacttatcaagggctaaaggccggaattagcgagtatttattgaacgtccggaccgatgtcgctttgctgttgtcgcaatatgaagttactgatattattcggcatagtgtgggcgtcgggagttttgggtcactatgttacttggttcttctgacgagtacggatggtagccatatggtgttacaaatcaaggaagctttaccaacgcggaaagtcgggagccagtcgcggccagcgttaacggccgccatggaactgacggaaggacaacggatcgtcagttcgcaacgcattttacaagcgacttcggatgcgttcctaggctatttccaaatggaaaataagagtttttatgtccgtcaatttcgggatatgaaggaatctatcgatattccaaccctagactggggtcaattccaagcctatgcgaatacgtgcgcaatgattttggccaaggctcacgcgcaaagtccaacggcggccatgattcggggatacgttggtaattcggcaaagtttgatgaagccatggctaaatgggccacggcgtatgttgaacaagttgataatgattatcaagatttcttagatgtttgatggttttaaacgaagggctgatcacatatcgcgctgcaacgcgtgacgattagacgtgtattgaaaataaaggaaggtcatcggagtcattgatactccgatgaccttttctgtcggtaattagacatagactaaaatattttcttgggacataatcattgatttgacaacgttttgtggcaatcaagcaagtgatttttaaaattgataggctaaaatggttgcactttttcaacaacttgatatacttactattagtaagtgaaatgaagaaattagttttgaaaggattgtttgatatgacaaaatatggtgtaattgtaggttctattcgtaaaaattcttattctaaaggggtcgctgaagccatcgttgctgggttaccagacgacgctgaagtaacgtacttaaatatcgctaagttgccactatataaccaagactacgatgcggattcacccgtagaatatacagaatttcgtcaggccgttgcggctcaagatgcgttcatctttgtcacacctgaacataaccgtagtatcccagcagccttgaagaatgctttggacgttgcttcacgtccatggggtcaaagtgtttggggcggcaagcctgctttggttgcttcccaatcgatctctggtatctctggcgtcttagcacaccatgttttacgacaatcattggtcttcttagacatgccaacgatgcaacaaccagaattgtacatcggtaatactgataagttggctgatgaaaatggtcatatcacaaatgaaggcacccaatcgttcttagctggtgctggtaagcaattcagcgaatttgcagcgaagtttgtcaaataattgtggataataaataaattttcaaagtacgttttattgtcgacacaataactgatacgagcgaacggttattctaagccgcagttttgataagaatcaagcttgattgcttgctgcttcatgataagcatgtaattgcgtggcaactagatgggccgggttaccgaccgcagtaacgtgggcgggaacgctgtctaaaacaatcgcaccagcaccaattttactgttggcgccaatcgtaataggacccaagagttgggcgttggcaccaatgaaagcaccgcgacaaacaaagggatgccggcgcctggcttgttcggttttacgtgcgcctaaagtgacgccgtgtaaaattgtaacgtcgtcttcaatgaccgccgttgcaccaatgacagtaccaataccatggtcaaagaagacccggtgaccgatttgcgcggccgggtgaatcaggatgccggtacgccgagccgcatgttggctcagcaaggcggccaataaggggaaacggtgtgtttcgaaataatgggcaacccggtaccaggcgagcgcgtgaataccaggataggtcaacataactgtccgcaaattgatcgcggcggggtcacgattgagaatggcacgagccgtctgaaacactggcttaatctgcctgaatgctagcgaacccgcgctcaaggtctgctaacaaatcgtcactgtcctcaacgccgaccgataagcgaatcagttcgtctttgataccattctgtagccgaattgtgtgtggaatggcaccgtgagtcatcaaggctggaatttcaattaaactttccaatgctccgagactttcggcgagcgtaatgacttgtaaatgttcaacgaaggtctgggggttcattcctggttgtaattcaaacgagatcattgcgccgaagccattcatctgttgcttggcaatcgaaaagtcgggattatcaggatcgcctggatagtaaatcttagcaaccgctgggtgagactttaaatacgtaaagattttagcggcattgttcaggtgggcttgcatgcgcaatgccagagtcttcataccacgttgtaatagccagctttcttgcggagccaaaatactaccgatggcattttgcaagtagccgattttttcgccaagtgcgggcgtcttggtgacaaccaagccaccgataacatcactgtgaccaccgagatacttggaagcactgtgtaaaacaatgtcaacgcctaaatccaggggcttttggacgtatggggaggcgaaggtgttgtcgatgatactcagtaaatcgtgtgcttgcgcgagcttcgcaatggcagcaatatccgtaatgtgtaataacgggttcgtcggtgtttccaaataaatcgccttagttgtgggggtaattgcggcttcaacggcggccaagtcacgcgtatctacggctgtaaaagtcatgccaaagtgttttaaaacggcgtcgatcaagcggaaggtgccaccatagacatcatttcccacaataatgtggtcaccagccgagaatagtgagaagacggtattaatggcagcggagccagaagcaaatgcgaagccagcgctgccatgttcgagggtggcaattaatgcttcgacggcggcccgggttggatttcccgtccgtgaatattcgtattgattttgaccgatttttgtttggcggaaggtcgaggccatgtagatgggtaccgaagtcgcaccggtagtggcgtcctcactgataccaccgtgaattaattgggtttcaaatttcattgttaaagtcctcattttgtatagattttttgacttagataacgctcactactgtctggaaagatggtcacgatatgactattggcaggcaggttggtggcgagttgcaaactagcggctagcgcagcgccgctagaactgccaatcagtaaaccgtggtcacgggctaggtgtcgaacttgggcaaaggcatcattgtccgcgatggtcagtgtctgatcgatgcgaacctgatcgaaaaatggtgggatgaattcgacgccgattccctcggtacgatgtgcgtgagctggtccaccatttaaaatggaaccttctggctcaacgactacggctttggttgctgaatcttgagcttgaagataagccgctactccagcaaatgtcccgccgctaccggctccggcgacgaaggcggttataggtgcaggcatgtccgccagaatttctggtgccagtgtgtggtaataagccgcgggattagccggattcttgaattgcatggggacgtaactgttggaaatcgttgcggctagtgcctcagctttgcgaatggcacctttgattccttcctcgctaggtgtatgaacaatttcagcacccaatgcttgcattaaaacttgtttttccatactgaacttttctgggacgactaagatggtacgtaggtggtgcgcttgagttgctaaggctaaaccaattccggtgttaccagcagttggttcaataatcgttgtcttggcgttaacccggccccgttgcaagccgtcttcaatcagataggctcccagccggtccttaatactgccgccggggttgaacatttcaagcttggcatagatgtgactgtgatttggaacctcgatgggtaacgccatcaggggggtgtggccgataagttcttgaacgtgctgaatgagcatataaattcctccaatcgctgcggtggggtgccaaaagcgacaaaaaaggcgcgagaattcgaatgaattcctcgcgcccagtacaatatccagccatgctggacattgatttttaggatgacactcctcaaaaagtcaatgcttaacaggccgaacatcgcgataagcgcgcagttcggcaacaacagttattcaaagcactacttgttaattgagtcatatctgatcctcctctggattaattgggactaactatacaagatgattttgagcgcgtcaagtggtgaatgacgatttgcaataagcggtaaaagatgaagattggctgagaacgttattgaatcagcgttagttttgccaaacggttgtcattaaaataaatatattaggtggttgaattagttgattgtgaccgaggataaaggtgttaaaatttatccaatatcagtttttcatgtattagaatcaagacgcatataactagttttattctggcaatatcagtgaacgtgctgttaataataactaaaacaatcccaccctgattagcaagtgactaaactagggtgggattgttcgtgattataatttaaatgatattacttattccataagtatttagcatcaaaatcattatcgaatgatgataaaatcttaggaccgtcatcggtaacgacaagggtgtgctcgtattggcagctaagactgccatctaaagtgcgaacagtccaaccgtcatcggcagtttcgccagaacgccagtcgccaatgttgaccattggttcgatggtaatggtcataccagcttttagacgggtgccgtgaccagcctcgccataatgtggaacgtcaggcttttcgtgcatcgtcggtccaataccatgaccaatgtattcgcgtacaacgccgtaacccatttcgttttcagcgtaattctgaatagcccagccgatatcaccaattcggttgccgacaacggcttggtcaataccgaggtatagtgctttatgggtcacttccatgagttttttaacttcgggtgatggtgtaccagcaacaaaggcgtgacaagagtcactaaggtagccatggtagttaataacggtatcaacttttaataagtctccatctttgaccaagatatctttactaggacagccgtgacaaatcatgtcattgacgctgacacaagttgagtacttataaccttcaaagttgagttcgccaggggtagcgtcgtgtgcaacgatgtattcgtaggcgaagtggtcaacatcccaagtcgtaattccgggcttgatgtaatcttcaagggcgtgaaacaggccaaccattatgtcaccggcagcttgcatccctttgatttcgcgatctgatttaagcgtaatcatgagtttcctccaaaaaaattaattatattgtgatgctaaaagtttgttcctctccagtatactgcaagcattgtattgcgacaaaacgcattgttttgacctgatattgacaacgctatcagtaggccgaagccaaaaaaatataaaaaaatcagcacgccaaaaataccaaattgccggggcgcagttggattaattgtaaacaattcaatataaacttggaattttacccttttcatcggccaagataatgatacgatatattgtgttgtttcaaacgaaaacactacatgtagtggtgtgacgtgactggttggccaactagacacctacaaccgcatatgaaaacggaaagaggagcatgattttgagtaattattttaaattcttatcacaccaactaaaaggttggccacaacaaaactactatctattctattttagcctaggatgtcaagtaatgacgttagtaagtgcgccaattacagcattgtctattttaacatttattgggaccactttgggtgttctttgtgtgttagctattaatgcggctaagtcggtcaatggcttattaggcgtcatctccgccgcttgcttcatcgtcgttggtttttcagctaagaactatttaagcattggggaacaattagcctacgtcgtaacgcttgatattccagtactattaagtgcaaattggaacgtcaacatggtttcgaagattcggaagtttacgggtaagacgtgggtcgtcgcaattgtcgcaactttagttgtttatgccatctccggctatcttatcggtgccttaactgatgatccccggccatggatcgatgccattagttttgcaatttgtttaacggccggcgtgatttgcttcctccgttacaacaaccagtatttctggtggattgcctctggtttagcacaaatggtcctctggtttatctcattccgtcaaggttcggcgacgctagcgatgttcatcaatagttccgtttatctgatgaatgatgtcttggctttcactgtttcaccttggtataacaaacatgaacgcgctcggttgatggctgaagaacaagcaaccagtgacgcagctagcgcggatgctagtgataatcaggcatttggattgaatcactaaaggtcagctaataaatttactgagactagtagcgttaatattctaaataaggcgagtactgtaattcttttggattagagtactcgtctttatttgaatagctccggattgtatcagttatcaaatataagcttttttattgacattataataaataatgttaaagtttaataaacaatattaaaaaagagggatgctatggactggtttgtgaatttagaacgtgaggatcaggaatttgttaaacaattggttattgcctcaggttctctaaaacaactcgctaagatttatcaagtgagttatccaaccgtgcgaatgcggttaaacacgattattcaaaaaattaactttattgaggacaacggtgcaaatacgtttgaaacgaaggttatgaaattggtaatcgatgagaaattatcgttagaggtagcaaaacagattattactgactttagggaggaacaacatgagtgattttaaaggaattctgcttggtatgttggtcgttgcagtgctctatatgttagatcgatacttaccaaggtggtttggggcaattccgggagctggctttttaggctttattatttacattgtttttacaaaagaggtctctttattatcaatagtaaccgtattgttagttggcgaagccgtgctgaatggtatctggatagatgcactcgtgaaccgaaggagaaaaatgaaaaaagaagtagcaacaatgaaagcgaaagatttattgcgaaaatagtaatattaatgaaatcatcagatatagaatcgacattggttggagattgctgttagcgctctgcgaatgtcgattttttattatggtgcggactatcctgctagttaaaccaatactgtatagatgctggcacttattatgaagtagttattgaatactgaaatataagctcgaattttgtaaactctagacatgtctagacttgatctggctggtataatctacaaatttaattgggttattacttaaatattgacaacttgtctaaacaagtctatattcataaatgaaaacgataacaaaggggtggttgccgtgaataaagcggccttagtttatcaagatttgctccagaaaattgatgcggaggtttacccgatcgggagttatttgccgagtgaacatcaactttgtgagctatatgggatttcacgtgagactgggcgcaaagcattagcgacattggctgaggatggctatattcaaaaaattcgtggtaaagggtccattgtgattgaacatcgacagtatgaatttccagtttctggcattgtgagttataaagagttagccgaaaaattacacattaagacgcaaaatattgtttatgactatcaaccggatgcaacgttaccggttgctgactttacgtcacttggtaccgaattgacggaagcgccagtgacggccatcaaacgagtccgagtgatcgatggcgaaccagctattattgataaggattatattttgaaatcggtcgttccgaaagttcccaagcaagcggcggaagactcactgtacgcgtattttgaaaatcagcttgggttgacgatcggttacgcgacgaaggaaattacgatggcgccggcaactgatgaggatcgcgaacacctcgctattagtaagggcgcctatgtggcagttgttcgaagcgtgacgagcctcacggatgcgcgagcgttccagtatacggaatcacgacaccgggcggaccgctttagtttccgcgattttgctcggcgaactaagaaataagatgtggcatgagagggatagcgcatgaaattatcagaacaagtgatttatcagatttatccgaagtcgttttacgacagcaatggcgatggcgtcggtgatttacggggtgttattgaaaagatcgactacctcaaaaagttgaatattgacatgatttggtttaacccgttttttgtctcaccacaaaatgataacggttacgatattgcagattactaccatattgaccccatgtttggcacgatggctgattttgaagaactcgttgcaaagctgaaggcaaatggtatcggggtcatgttggatatggttcttaatcatacttcaactgaacacgaatggtttcaaaaggctttggcgggtgatgagaagtatcagaagttttactatctccgtcctcccaaggctgatggtagtctaccgaccaattgggaatctaaatttggtggtccggcctgggcgccgtttggtgatactggtttgtactatttacatttatatgatccgacgcaggccgatttggattggcataatccggccgtacgacaagcgtgtgccgccgttgtcaacttctggcggcaaaagggcgtgcagggctttcgtttcgatgtcatcaatgttaccggtaaggctgagaagttggtggacgcacctaagggagtccctagcaagacgttgtatactgacacccccgttgttcatgattatttaaaggaattgaacgcggcaagtttcggccagaatgtagatagcgtcacagtgggagagatgtcttcaacaaccgttgcgaacagtgttggttatactaatccggctaatcacgaactctcaatggtctttaatttccatcatttgaagacggattatgttgatggacggaagtggtcccgaatggccttcgacttcccacgattgaagcaattattagatagttgggccagtggaatggcagctggtggtggctggcaggcgttgttttggaataatcatgatcagccacgagcgctgaatcgctttggtgacgccggtcgttatcgtgtcaagtccgctgaaatgctggcgacggtcattcacctcttgcgtgggaccccgtttatctatatgggtgaggaactcggcatgactgatccggactatgacaatatggctgattacgtggacattgaggcattaaatgcttatcgggctttaattcgtagtgggtacagtcatcacgatgcgtttacaatcgttaagaccaaggcgcgcgataactcgcggacgccgatgcaatgggatgatagtgccaaggctggtttcactactggtaaaccgtggttgacaccgactaatcaggcgacgattaacgtggcccatgaattggctagtggcgagatttttgactattatcaacggctcattaagctaagaaaaacgatgccgatcgtcgcggatggtggttatcaatcgtggcgcttagatgatccgcaagtcttcggctattggcgaacatatcaccaacaaaagttattagtgcttaataatttttatggtcagtcaacaacggtgacacttccggaagaaatggtcggtgcacaggtgttactttccaattatcaagatgttaatgtcacagcacaattgacgatgcaaccctatcaagcggttgcactgttgttaggttaagaatggaggaatgggtatggcaaaggcacaaacagtaacaattttgtcgccggtcaatggggacgttattgcgttaaataaggttaaagacccggtcttttcagccggtatgatgggactgggctttggcgttcaaccttcaagtggggaagttgttgccccagtcagtggtcaggtcacgatggtggctgagacgaaacacgcgattgggttcacaacgcctgatgatcatttggaagtattagtgcatctcggaatcgacacggtcgacttaaagggtgccccgttcacggtcaaagtggccgcgggcgatgatgttcaggcgggtgacgtgattgccaccatggatttagctgctattcaagccgctaatcgtcagaccacagtgattttagcagtgactaacactagtgataaattagaatcgttggacgtcgttacgggggcaaaagctgccggtgacgtgacagctacgggccgtctgaacgccaacacatataatgctaagcggcagaatcgattaccaaaagcgggcaaatatgatcagttagccgcggacatcgtggctaatgttggtggtgccgggaatattagtagtttgattcactgcattacccgcttacgtttttatttgaaagatgaaagtaaagccaatgatgacgtcgtgcgggacttaaaaggagtcatcgacgtagcaaaagcgggcggccaatatcaggtcgtgattggtcctgctgtcacggatgtctatgatgcagttatcaaacaaatcgggccagaattttcaaacgattcggagacggctaaagctgttgctgagactgccgcagcagctcagcggccaacgacgccgtggggcaaagttaaatggggtatcagtaatttaattggtgttatcacgggttcaatgattcccgtcattggattattagcagcctctggtattttaaaaggaattcttgcgttacttaccacgtttaatatagttagcccgaccgcaccaacgtacgtgattattaatgcgatgggcgactcggtattttacttcctgccaatcttcgtcggtttcacggctggtaaaaagttaggggcagatccggtaatcatgggaattatcggtggggtgctgacttatccagctattgtaacgatggcgagtggtaaagcgacgggtacgcttttaggaatgggtatcaacgcgaacttctttggcttgccggtacacgttgcctcgtatacgtattcaattttcccgatgattgcgggggcctggttagcaagtaagttggaaccatggttaaaacgggtgattccaacggtattacgaatgatttttgtgccattatttgaagttgtgattgtttccggtgcgattctattattccttggtccaattattaccgtgctttcaactggattggcaaatattattgtgtgggtctacaatttgagccctgcgatttctggcttaatcattggtggcttctatcaagtattggtgatcttcgggttgcactgggcggttattccgattgtggccaacgatattgcaacgacgggtcacagttacttgaacgcgattgtttcagcgacgatggttgcccaggggggcgcagtattcgcaatcgccttaaagtcaaagctggctaacattcaagaacttgcttggccagcaacgatctcagccttctgtggtgttaccgaaccagccatgtacgggatcaacttgaagtatggtcgggcctttgtgactgccagcattggggcggcagttggtggcttcttgaccggcttgatgaatgtcaatatgtggggctttacgggttcactgattggcttcacgtccttcgttaatccgaagggcttggactttagtttttatggtttcgtgattgcatctgcagccacgattgtcgtgtccttcgccttaacttggatgtttggttttaaggatgaagatgtcaatgccgttaaagtagcgcctaaaaaacggcacttaggtgcaactgcctagttaatggcggcgtcaaataattaatcaacgttaggataaacaagtatttttccgattcggaaaaatgcttgtttttgatatttagtcgccctaacgaagcgatgataagcgatggagattggtctcattgtgatgatagaattttagtggatcatgattggacgtgaaacgatcgtcttaaggatttttgagggttaggtcaaagttttacatgggggatgacgattatggggaaaatcgatgaagtagccattttagcaccagttactggtcaagtattgtcattggcaacggttccagatcctgtttttgcggcgggaaaggtgggaccgggatttggtattcaaccgacagctggtcaaatcttggcaccagttagtggccgagtcacggtcgtcgcaacaaccaaacatgcaattggcatggtgactacgactggcctcgaagtgttgatacatctgggtgtcgatacggtggtactcaatggggcaccgtttgaagttcacgtaaaggtcggtgatgaggtgacggctggtacattactagtcgacatggatttagctactatcgagcaggctcacaaaccaattacggtgatcgttgtcgtgacgaacgctcagcaggtactcactgacttgacgctagccccactgtcacaagctgtcgcggccggtgcagtcgtcgcaacggctcacttgataacagcgccaacaaccgcggcaccggtagtgtcgtcggcgccgcagtcaacgacgcgttactcggcattagccacggcaattgtgtccaatgtgggcgggcaacaaaatattaatagcgtgattcattgtataacacggctacgattttatttgaaggatgaagcactagcgcacgatgcggttattgcgaacttggacggcgtcattgatgttgcaaaggccggtggtcagtatcaagttgtgattggtccggcagtcaacgatgtttttgatgcagtgatcgcgcaactagggcctgaatttgcggacggcgtgccagtaccaccggttcaggaggcatcaagtgacgttaattggctcagccacgtgcgtaatggcattagtggtgtcattggtgttatgaccgcggcaatgattccagtgatcggtattttagcaggttcagggattttaaaaggaatcttggccgcgttaacgggcttcaaagtcttggcagtcacgagtgggacgtacatggtactgaacgcggtagctgatgcaacgttttactttttaccagttatcctgggctttactgctgccaaaaagttaggttcagatccaatcgtgctggcgattgtcggtgctgttcttatctatccaagtctgataacggcagctagtaagggagccacggcccaaatcacgttcttaggtgttccgacgcatttaatgtcgtattcggcatccgtgttcccgatgattgtggctgcatggctaggcgtgtacgttgagcgggggttaaaacgaattgttccgctgtatttacggagcgtctttattccgattatcgaagccctgattttggcggtagtggtattagtggtggtcggtcccttaattacgattattagtaagggcttggccaacggtttggtcgccgtctataattttagcccggccttatcaggattggttattggcggtttataccagacgatggtcattttcgggctccactggggcattattcccattgtgatcaatgatattgcgacgaatgggcacagttatttgaatgcaatcctctcgattaccatggtcgctcagggtggtgcggtgttggccgtcttcttaaagtctaaggataagcacctaaaggagatttcactggcagctgcaatttcagccttttgtggtgttaccgagccggcgctatacggggtcaatttgaaatacaaacgggtctttgtcgttgctagcattgcgagtggtataggtggcttactgaccggcctgttacgcgttaataactatgctttgtcagggtcgttgatcggtttccccgcgtttatcaccccgggtgtcggcattgggtcaaacttttatggttatttaatctcccattacgggacactagtgattgcaacgatgttagtttatgtatttggtttttcggataagttgttaggtcctaaggaaaacttaaaagtgactaataatcagtaactaaaataaggctcctgctgaacgtagcgggggtcttatttttatgaactaatcgcttgcaagcgtgcttgttgtcgaatcgcttcaacataaatgcggacaaagtcggtgccatacaggactgctagttgctgttccagatttggtgtgggtggcaacacctttagcaagggtcgaatccattgattggtgggcaatagtcgcaatagatggtggctggtgaactgtgagaataagagattgcggccgaagtattgtccaagatgattttggaaagctggttgcttaactggcaccagttggagactactgttattcatgttgcctagtaacaatttggcctgaccaaagtcgtcacgaaggtcaaaatgctgattcttgtaagccttagcgatttcaggtgctaattggaccaaccaaatgagctgatgttgttccaaatgcagaatcaagcgcagtgtcataatatcagttgtcgtgagttgataactgtattgttgcagagtggctggtgttaattcttgacgcaaggtccgttgaacggcgtcaaaattaccagcctcccaactaatggttaattgatcatggttcgtcagccatagcaaatgatccgcaatccgcaaggtcaagaagcgcggggcagccgtccccggcgtctttagcattagtagccagtaagagctggcactagaacgcgcaaaattgcgtgctaagacgtgcgcacaggttggcaaggccaattggacagccaattgtaagcgtcgccggtcagtagcagtattaacaaactggtgtgggtcgtgtgtgattcgtcgttttgccatagacatccctcatgttaaatttccccttatttatttttatccaatctttcttgcaagcccagcatagcttcttgagatacagataatccacgagcttctatcttttctgctaaaacctctggtagagtaatctgtctacgcacctttttgtatttccccacaacctctcgcatatcagtgtagatcataaccacatactcatctgtagctaatgcgacatcttttgccttggatgccggcggccatacttcctcatacagattcagttccaatgctgctttggcatttaaaactgcctccgcttccgtttttccctcagcattaacacctggtatgtctggaaatcgaacgaaaatttgttgcgagttcgaattagcttcctttttagataccggagtaaagactgctggatagattgccatattgcttttctgtgtcatatctaacctccttacttttaataaaatttattccgcagtacgagcggttttacaatatcaagcgatttcgattggttcatttttttgaacaagctcttgctaatcttgattcaccaacctcttaccagttttattcttgagaaggtaagtaattaaccaccatcgcaattgataccctgtaattatcttaccccatcagtaaattattctcattaaaatatttattggtgctgtatagtattaggtttcgatttcctaaaatgtcctattttcgtcttaatcgatttatttataaaccgtaattgcgaattctacaatccctctatcaaatatttaatcatccggttaggactcacaatctttgtaaaactgcgattataaaaaataattaatagcatgaatactgcccatggaatcaataaactagcgtacataagcgttgccattaaataatagaatgctacaatcaccattgcttttagtttctttgtcatctctatatacttctttcattaatacttcattgcaagacatactatacacacagtacttttaataaattattttttcttatagcacgtccaccatcgcagtctttcgctatcagtttggattctatggtatttgatattggtgaatttcatctgttaacgctattttcgtgcataaaaaaagggcataccgtcctgtgctataatcaagtcggccaaaaccaattgaaagctagtgttcagtgtgacctaaggccattccacccgagtattactccaaattaatgacctcagcatacgtcagtaatttggcaactcttttcccatgccaaacccgtagccgataattttcatttcgttcaaacgactttgtgctcactcaatcagctccgaatccaatttataaagcaattcaaggaccatacccgggagcaccgcctactcaaggcattattggtacttatatttaatggccgatgaccaccttgaaaaggttaattcacaatgtttcaaccacattaaagagcatttgatcaaagaaaagttcgtccatgaaggcttgaatttagatgagaaatcctcgcagacctacttcatgaatcacgaactagtcaaagcctttcaagccttgattaccaagcttttatcgccgctcttagacgaatcgagaatgtcaactctcaacttataatcaacatcaaaacctttattcataacaaacagctgattacactatgaccactgaacagctctcaaatgagctaattgaaggcgttaaccggaaaattaagcaaattaaacgaaccgtatatggttacaagaactgacaaaactttatttatcgaattcaaattgaaatcaaaatcaaaaaaagaacccaattcataaatgaattaaatccctgaaatagttctcatcaacactggttaacagagaccctttttaagaccacacaaatcttgtttctttaattcatagttgcgaaacattaccgctccaaataggcatctagtaatacaagattttcagccatccaacaactaaccactgcgttgaatgccgtcttgaataaaactcgcttgcttcaaaaaaacagtatcaaaaagagcatcagatccagcaaatgttgttgaatctgacgcacgatattaagacaccgcttacggttgcgattggttacgttcaacttattcaacatcaaccgtcgattgcaactcctcaaactctaacgcaaattgcacataacttgtcatcggtaaattattatctccattatttaatggactttaacttacttcaggaaaaatcagtcaacgtcgtcttcaaaccgattaacctctcgcattttttagagatcgaactctttaacttttttgacgatttaaatgagaggcatttaacgttaacaccaatgattacactaaatatttccattaacaccgatgaagttttaatgcgccggattattcaaaacctagtaggtaattggttgaaatatgctactgattccgtttcaatcatcttaaaacctaaagataacaatcacattttattagaattcaaaaacgtaactcagctaccccaaattgatgttagccaattaacaaaccgcttctatacaaccgatactgcccgaaccactcaaatcgtcggtttaggattaagtatcgtacaatccttagttacttcgattggcagtaaaatgagtattgaatcagtaaacaatacctttacagttaatctagttttgagaactacgacaccgacaccttgataagacttcaaatatttactactaccgcctttagccatacttagacactgtaattagtcggcaatttaatacattgatggttaggttagttccacctgatgccaacgacttcgcacgtaatagttcttgccccgccgatcaatatcgtccaggtttgtcaaaacattattaaccatcgtcttcgtaggcgctgcattttgatttagacctaatttcttattcacacgttcaaaaactaacggcgtatagcaaactttggctttgattgtttctaatacctggttgttcatttggatattcctccctgtttcgaacatacattctcaatcgttataccaaactaaaggcgtattgataatccgattgataaactaccgttattaattttaaagtactttcggccttagtccaacatgtactgaaagccacttcaccagtcaacaagttagccttgaacaagctctggttgtcgctgtcctcgtcacccataacaacgaagtacgcggcaccttcatcggccacgtattggaagctcaggtagttgctcttaaacccctatttccggaacaagccaataattcgaatcatttcacttgtgttacttctgttgctttttcagtcaaaaccatgaatatgtgtttaatggatgactgatctattcaacacggcagtcgtttctatcacttaagtttgaaattagtgctgctatggattcagcatctggggggcatattatggcttggggggcgggtgctaattcgggtttactagtaatccaaactgcttgccgggcacaacctaacatgattcgatcattttcgtcattgccaaaagcaatatagtgttcaaaaccaatattagccaaagcgtgggccttattaattccttgggcagtgacatccaagcttccttcaccactatgttcaatgacgactagatctagtgttattaataatcgcttgattcttgcgcgcagtactggagctagatttaataaaataactttaaccggatcatttaaagaagctaatgattggcgttgggctaatcgttgaggatcaagttgacgtaaaattggattgtcagtagaaacttgactggcataattccacgtgccatccataacataatctaagtggtgaatttctatgagctgcttcaattgttgaacagcagcgggtggtaatggttggagaacggataacttttctgaaacccgggtcataacaccattaccaccaattaagggctgatgctcaaattctgggataatgggaagtaagtcgcgaattggtcgagcagacgcaaagacaactttatggtgcgctcgaattaagtaggttagtgcctgtgtaatgggtagggcgatagtccgaccatcaaaacttaacgtaccatcgatatcaaaaacaaaattcatgattaactccttaaattaagtgaacgttcaataatctcatcttttgcgggaatagacaaagataattatacgaataatgttgttaaaaggctagctctaatttgggtgatggaataaagaccaatttaataacagaaaagacacaacaaccagactcggtcattgtgtctccagaaacttattattttgaacttacgacgtgatcttcatccagcatatactggaaagcaacctcacccgttaataagttagctttgaacaagccttgattaccgttgttctcgtcacccatgacaacgaaatatgtggccccttcatcgacgacgtgctggaaactcaggtaattacctttaaatccttgcttccggaacaagccaataattcgaatcatttcacgttgtgttacttctgttgctttttcactcatatttaactataactccaattctcttctttaatcttattttgccgttttatttgttggcttattgccagcgaccacgtaactatcagttagcggggtcgcccaccaaccgttaaatcctaaactcattgactgggtgatttgcaagccagcgtctcgaaaagcctgaccgtactcgttgatattgcgacccgtatcaatgatcatgatgtgtccaccgggtttgagtacccgaatggcttccttgacagcattgattcgggcttgttcatttttgatattatggatggcaaagctggacgtcaccacgtcaaaacttgcgtcaggaaagtctaacttggtcatatcccccgttactaaattaactcgattcgttagtcctaaatcatccacgttcttttgtgttacggttattttgttatgtgattggtcccgcgacaaccacagatctaatccggttactttgccagctggtcccaattgttgggcgattttggtcaacagtgctccccgaccacagcctaagtctaagacctgactgtcaggtgtcaagttcaagtggcgaatcgcctcatcaaacagtcggtacttcccctgagttgtggtgtgtaaaaaaatcaacgcacccaacactaatacgattccaatcgttgtttcgatgccgattggatagttcaaccgattcacgtacgcgtgccagagtaaccctacgccaaacacggcatagatcagcaacgcatacggcgcatcgaccccgtaccttttgatattcatccagctttgtccccttttaaatccccgattttcgtttcccccgatcaatcgtggggaatgggggctaagggggcatgctttgaacttacccgcttagctcctacttcttaatcactgttttaaccggtagtgtccatttagcgtccactacccctaattcattaatttaacttatcatcagtcattagcgaagaattccaaagccttcaagcaatccttcatcaattttgattataatttaactcatcaaaatattctgattggtctactgctttagtcgagccaattcatcgtcaattaaccgcgtggcgatcccaaacgctttcaaacgtcgctttgccaaggttaactgggacttataacggtctggttgttccttagcttccaaagtcttaataacttcctgaatcttatgcacggtggaatcaatttggcgtttagcttccagtaattcagcttcatcatacatcgtatagtcctcccttgaaaacggtcatgaaaactaagacttaggtttcataatgacaaccagcgtccatttagcgtccatttgccaccaactgccaacctcatcagacgttatcggccctcagcgcccaaaaaagcactcccctgagacagcggagtgctccaaaaaactagtaaataactattaaattatttgcctaacttttccttaccaagaacctttaacttttcatcaaagtcatagacaactggttcgccagtagccatttcaaggtccatgatatcgtcatcactgatttgttcgatgtacttgcttaaggcacgtaatgagttaccgtgggcagcaatgattacattcttgccgtctaataacttaggtgcgatttggtcttcccagaaaggcatgacgcgttccaaggtaaccttcaagttttcgccaccagggacgatgttagggtctaagtcagcgtaacgacgatcgttaacggctgaaccttcatcatcggcactcaataatggaggtaaaacatcataagaacgacgccagatatgaacttggtcgtcaccgtatttttcagcggtttccttcttgttcaatccttgtaatgcaccataatgacgttcgtttaaacgccaagtcttggtttctggaatccagagttggtcggattcttcaagcacatagtgcaaagtcttgatggcacgagtcaaaactgaagtaaaggcgtaatcgaattctaagcctgcttctttaactttttgaccagcagccttagcttcttcaacacccttttcgcttaaatcaacgtcaacccaaccagtaaattggttagataagttccattcactttgaccgtgacgaatcaatactaattttgccatagcagttaatgacctctttcttaagttatttactcaccctattttacactgaaaaagcgaaaaatcaaaacaatatcagcgcttattttcagaatccgggtggaaagtaatcgtttttttcagattaatgttaggtcgcggccggtgaaccggtttcacgccgatgatgtccaaaataaagttaaaaatcggtacaccgacgatcagtccccagacaccaaacaaacgctcactcactagtaatacgacaaacgtataaaaaatgggcagctccgtgcgactcgacataaacttgggattcaagacataggcttctaaggcgtgcacaaccaaaatcattaagagcatatagaccacgtagcgcaaaccgccaaccgaataggcaatcaagctcagcggtacgactgaaataatcaccccagcgactggaatcagacttaaaataaagatcattaatcccaagctaatcagttgcggcatcttcaagattgccatgaaggccaccgtaatcaccgtattgacaatcgcaatcaagaactgtgcttccaaaacaacgccaaagctattcacaaactttttggcaaagaaatggacgtcttgaaaaaaccagccaaacgtactagtcaaaaagcgcttcgtgaagacccgcatctgatggtcctcaatcgtaaagaagaaacttaaaataaatgataagaagaaggttagtcccatattaccaatattagtaatatactggaacacaactgaaatgccgcccttcaattgtttgagtatatccgattcttgaaaatacgatgtcacccacgtcaacacttggttagtatcatgtgatgggttctgataaaaccgatagactgattcaaacgtcaaaaaagtttgtttgatcaactgcggtaaataaatcgatacagcaaagtaaattccaagaatgactagtgcgtagaccactaggacaatgatagtcggtggaatcttcacccaccgccgaactgcccgaactaaccgcgtcactaagaacgtaaaaataaacgttaataaaataatactcatcatacttgatgccaagtatagcgttaacacaatcaacgccaatacgcaggcgcgccgccagcgcacatttcgtattaactgtgaccaaaattccacaaaatccacccctctattatcccttactcctattctaacgaaaaagcgagctaatcaaaatcaaaagcttgttatgattcaacaaaaaatgcgtaaagtttatcactaatcactcgataaacttcacgcgttcgtttgaattgacactttatttttctaggagaactgcatctttaagctctctaatcctagtgcttggtgaataatcactgaggcgccacccaacaaggccgccgattgcacgttcttggttgcaatgattggaacttgccggcttggcgaagttagcttggccgtgctctcccgaacattagtcaatagttgtggcaagatttctagaacggtcgtgttcaagacaacgacgtccggcgcaaacgccgtggaaacattcgcaattactttagatagatagtaaacaaagtcatcgaagacctttgtcacttccggatcatgattgatgtagtcatgcttgaccgtcgttaaatctaatcgatcaacatgcttgatggctttcaaccgagcccacaaggctttttcagaagcataatcgttaactgatgccaagtggtcctcaacgtgccgatcttctaacaaagcagtccccacttcacctgcttcgccttcatgaccagaatatagtcgcgaatcagccacgattcccgcatgaatctgatcgcgaacgactactgaaaccacgttatcgaaaatctcgttgtcatggaaatcacgttcaaaaacggccgttaagttagctttcttttccagaacaaccggaatccgtagcttatcacgtaaatactttgctagatcaaagtgtgttagtcccttgatcggtgtcttgaggattttattctcataaataatcccatccagcgcaatggcgacccccatcagaccatgaatcgtaccatagtcatcaacgttccgtaattgatcttcaatcaaatcaatgacatccgtcaacgtcatatcgctcgtcttaaagctttgaaagtgcaaaattttaccgttcaaccgtgaatacatgagtttgactgcgtcagccgacatgtcgatgctggccacaaaaccatagttcacgttcagctcagccatcactggtttacgaccgccgtttttcgtgctgacaccacagccaatttccttgatgaactgggtccgcagtagctgattataaatatctgaaaccgtcactttattcaaactcaaattccgtgaaatctggctccggctaatcggcccttcgttaataacctgctgcagaacttgcttttcattcgtactgcgcattacatgtttattaataatcatactgaatttcgatgcccaccattgacaatcgaactactttaccaaatcatgttaatttgggctgccattaattcaatcctcaacgagcaccttaaccccctaatctgttaatattctatagcatcaaacaaaaatagtacacaaaatagtcaattttatacccattttgacatatgaacgttaaaaaaaggccaataccgatataaaatgaccgcccccgtagaaccaaaatatcaagaacgaaaactttccgtccttactcctacattctataacagtttttataaaaaaatcaccgattgacacctaaaagtaggtgttttatcgatgattgttaagtggacttccatactgttattaaattgcttatattactgcaccgactttgctgcttgcgccagtgacagatgttgtaaactggcttgttgtaaaatggcctcgatttgggcatccgtatactgactagcattaaatccagcttgcgctagctccgcacgcgttgcctgaatctgatcagagctataattcatcgtttgggcagcttgcgccagtgagaggtgttgtgccgctgctcgttgcagaatagcacgaatttgggcatcactataactactgccgtcgagcccttgcgcagtcaactcagcacgagtcgtctgcacttgactgtcaccataactgttgttagctgcagctgacgagcccatcgaatggttagctgaggaagttgatgatgaagcagccgcctgctgtttagtggctggcgtgcgttgcgtttgttgctgacttccggtcatccccgtaaccgcttgtgccgcactcgggatcaccggtgctgaaccggtcaatgtcttgagtgacgcattattttgtttctgtaaatccaacacatttttccgaatatcggaataataacgttgcttaaacgtcttatcttgcagcaattcagcgattactacgttagaatccgtgaactcgttggccttattcagctcggaggctttctgatactgttgttgataagtcttgcgtttacgctgtaccttctggatcaaagtaagttgtgcttgggcctgatcaatcaacgtcttcgccccatgtttggtattcttgaccgctgtaaaatcacgtttggccacgtcaaatttacgggcagtcagtgcctgctgaccatccacgtaagtctgggtctgggttaaataccgttgcgcctcagtactactagctttcgttctggtcgcatgtgtaaagctcgtctccgctaacgtataattccgctcttgcagtgcccgctcaccagttcgcatttcagccgtgtatgagtcttcctgcagacggtaccgcgtatatgaataactaccaacccccacagcgataattactgcaaacacgatccacatccatcttttcatcacgacacccccatcaactgattttgtaattaatttattataacatgtttacgaatcaggtcgcgattcgttgtgcttacaaaactgttttcataagcgtataataattagtgtattttacgaagaaaggatccttattgcaatgctagaaaaaaccttttaccacacccttctaagccactcattcaatatgcccgtcacagtcaactactgggatggaagtagtgaaacttatggtgaaggcacaccagaagtcacggtgacttttaaagaagccattccaatgcgtgaaattaccaagaacgcttcaattgcccttggtgaagcttatatggatggcaagattgaaattgatggcagtattcaaaaattaattgaatcggcctatgaatcggcagaaagtttcttcaacaattctaagttcaagaagttcatgcctaaacaatctcactctgaaaagaagagtcaacaagacatccaaagccattacgatgtgggtaacgacttctacaagatgtggcttgatccaaccatgacctattcttgtgcttacttcaaacatgacactgatacattagaagaagcccagattcataaggttcatcacatcattcaaaagctcaacccacaacctggcaagaccttactagacattggttgcggttggggtacgttgatgttgactgccgctaaagaatacggcttaaaagtcgtcggggtcacgttatcacaagaacaatataacctcgttgctcaacgcatcaaggatgaaggcctcagtgatgttgctgaagtccggttacaagattaccgtgaacttggcgacgaaactttcgactacattaccagtgttgggatgttcgaacacgtcggtaaggacaacttagcaatgtactttgaacgcgttaaccactatcttaaagctgacggtgttgccttattgcacggcatcacccggcaacaaggtggcgccactaacggttggttagataagtacattttcccaggtggctacgttcctgggatgaccgaaaacttacaacacattgttgacgccggcttacaagtcgctgacgttgaaaccctccgtcgccattaccaacggacgactgaaatctgggataaaaactttaacgctaagcgcgctgccatcgaagaaaagatgggcgtgcgcttcactcgcatgtgggatctctacctacaagcctgtgccgcttccttccagtctggtaacattgacgtcatgcagtacctcgtaactaaaggtgcttcatcacggaccttaccaatgacccggaaatacatgtatgcggataaccgaatcaataaagcttaattaaattcaaaaataccaactatctcgattatttcgaaatagctggtatttttttgactatttttttagaatggccgacaactagctttcagtcgccgccatgcgtacccaacccaagatctgatggtagatgagtaacgatcctaggaagaaagcggccgctaaaccggcggatgttggcagcttgttaaacatattggctggtaacactaaggctaatagtggaaaggcatacgctgctggcaattgtaagttaagcgcccgtaaccacaaatacacaagtggtaaggcaatgaccgtcgttaatagccacgaagcaatcaataggtgaatgccgaccccaatactagcagcggcagacaatgcaagccactgcttaagcgcggtcgttaccgtatattcagactgttgagccgcttcaaagaaaacgacgatcacgggtgggattgcggccatctggggctgtcccgctagccaaacaatacccacccagacaaaaactaggctgataaagccgagcatctgccagtgattagccgaagcttcggttacccgtgaaattgatcgtggtcgttgaatccaagccccaatcatcaggcaaatagtccaaaaaaagatagctacgataaaggtccagtgcgttgcattaatgataattggcagtaagccagtagcaaaggctggcgccaaattcgattttaaccccttcaataataatagcatcagtaatagaccgacaagcactttgagggcgtacgaccaaggtagtcgattgactaagaagccaataattgcagttccagatggtactaagaataactttaagggttgccgagtccacgccgtcttacgataaacccacgtcccggctgtcagagcaccgatttcgggtaaaatgatttccgcatcatgttgcaatgtggcactcgccaccattaatagaatgaagctccacccagctaagtatcgccaaccatcgctttgctttaaatccatttcgataaaatattcctttcttatatttaattagatatatttatattatcaaacgtcaacgactagcattgtaccataaatacaatcgtctcctcaaataatcctaaaaacacatcaacagttttcaggattattttcaatcactttcctgacctctaaatcaaaattcgactgagtaaagtcttacccagtcgaattcagtcgtcgcgccaacgcagtcgcgacgttatcaacaccgcagtcagaaaattatgcattttgcataagccttttgataactaaacggttatgctatttatcgtactagtaattggttaaccagcctacgtacgctagccattacgggctaacatccagaatataaagatagcttctgccgctcgtaaccaccaccgatatcggtaccagcgggatactggccaacgccgttttagccactgattggcatagtgcgcaatcagtggtgccccgataatcataaaaccctcggtccaaaaatcgacgcgggcgggccaagtcgtgttatcaaagccagcaccaatggtcgcaactacgagcaagatgtagaggccccacaaactgatttgtaaaggtcgtttgactttcggccaccattgccgggcctgtattcgcctaatcattgattgatggtgcggccgataatgctcatgaccaggtaacgctgctaacattgcagtcgcactttgatatcgttgctgtgggtcgagggccgtggccttcataataatcggggcccatgttgaatcctgtgtcagtgttgctgcatctaagggcccactcggctcttgaccagtcaacaaacagtttagaacgacccctaacgaatatagatcgctccgttgatccgtttgggcaaaaccatagttttcaggtgcggcaaaaccgctcgtgcctaataaccgggtgtcactgtcttgctcagcatgatattgtcgcgctgcgttgacgtcaatcaaatagtagtgatcccgataacacatcacgttacttagtttaaggtcccgatgcacaatttgttgttgccccaacgcctgtagcgttatcaacaattcttgtgcgacgcgcaccgtcatttcgggggaaaacggtccttgtgtggccaatcgatccactagtgtttgaccattaattaaggtctcaacacttacaatgcaatcagtcgccgttaataatgcttcgatccggggcattcggggaattggctgctgcttcaaacgctgtagaacaggaacattatcaggatttactagtttagctaccgaaacaacctgttgcttcttaaccagtaacggaaactcgcgttgcgcaactaatggtcctagtggttcataaccagccgtacttaacaattgcattgcttgaacaatcggtaacaccgtgacacccccctttttatcaaaattactaacttttatcataaccatacttttggaggaattacaatgtcaaaatatcagaataacgaagtcacaccagtcgcacaccagtcgcgaacagccgaattagttttaggaattattggcggtatcttcggtatcattgccggcttactggcgatgaccatcggcggcatcggtagtgctttagaaaccagcggatcggctggggtcagcaatcttggcgttggctgcattattgtctctgtcctcgcgattattttaagtgtcatgattaatcgcaatcacgttttaatgggctggttgatcatcctttgtgggattcttaacttcgtctttgtcagcttcttcgggattctaagcggtctgctcattgttattgcgggcggcttagcactaagaaagtaggtaagctcatgcaaaaaacgaaagcttggtatcaaaaatggtgggcgtgggtcctgattctccttggcatcttctttgtcatcggcctcgtcaattcttcgcaagacggcaaaaactcacaagcagcgacggccaaaaaagccagtgctagcaagtccaccgctaaggaaaccccggcaaatacgatttataaagtcgggcagacagccaccatcgatcacgtgcaagtaacagttaataatgttaaaaccgcaacgacgctcaatgatgttcagcctaaaactggcaatcaatattatacggtcaccgtaacattgaaaaatagcggtagagataaagtcagctataacccgtttgactttaaaatcaaggccgccggtaaccaaactagcctagatgagatcaacattgatgaaaataaccaattagatagtggtgacctgaccgctggtggctctgtcagtggtaccatgactggtcaagccaaagcagatgggtccgttgaactcatctacaatcccagctacttcagtgatcggcatttgacctttaaattacagtagtttctggtacactaatactaattaagaaggagtattaggggggcactaaccgtggtagaacgcgcaactaaggaactatttaacgaaatcaaacatgcaagtgaggccgaccaatttatgacaaatatggccaatagttttattcgtaccaatccggcggaatacctcgccgagcttattcaaatcaaacacgtcactaaaagccaagtcattcggcgcgctaatctaacgccctcgattggttaccagtacttcgatggcaagcgccgacctaaccgggctcgcatcatcgccctcggattcggttttcaactgaccctgaccgagcttaacacgatgctcaaacgaaccggttacgccgtcctgtatgccaaggatgaatgggatgctctggtcatcttcgcacttagtcagcgctttgatcttaatcgtactgatgaactactttatcaatatggtctaggtacgattaccgacgaagattagcgtagctgctagcgtccacactaatgttcgatgcacctttcagtcaatccacgccagccaaaagttcggcataaccaggttttagaatactaaaagaacaggccctaatgagttgaatgctcattagggcctggtttgctcaatctaggtcaaagataaagatgatggtttcaatcaatacaatgaacgggatgtatcgaacaaataagataaagtaccagaaggcctcgttaaaactcacaacattgaatctagttatccctagaataatcaaacaactaactagtatcaaaattgaaaatagcttttttacccttaatcgtttgccaaaccctgaccccataattacagccagcaacagcccacagctcacatacccagtgagctgattactatccagtttaaatccaatatgaacacccgtcgaaaaataaagtgccgcaatgtatatcagcaagtaaatccctgcaataagttgaatccgtctgtagatagtcatatatctccccaatttaacagttcttaaaataaaactatactaaaagaaaaccaataagccaacgcttttttcagctatgtagcacctgtaattaagcatcgttaaaataaaaaatcttcaactataaatatttcaatcctggttgttcaactttagaaccgtgcgcaaggccaattaagaagctacagtcaggcacgctcaacggcactatcttacgcatccacgtccgctcccaaaacagataagcactgttccagctgtagctggcaaattcttgattattaaattaataatattcaatttatacattcgggttaactcgtttataaccgaatatagatcgtcgaagtgaggccgctaccttctgaaaatattttttaacaattggacgctttacaccatccaaaaaaggccagacgcatggcacctggctgctaaagacaactcgtaattaaggtgataatggtttgtcctaaactggcgcaatcaaataatacccgccactaagtccaatgaacaagtagatcaaatgccggactgtcgtcatgggtagccgcggcaggattcgcgccgccagcgccgtcccaatgaccgcaccgaccataccaatcataatatggggaagcaagaccggcgtcaaaataccgttcaatacgcgaactgtcgaaatatagaccacgtcgatcaaaaagaaggtctgcaaattacccaggtaatccgcagtcgtatcggcaagtgatagaaaataaagggccatcagcgggccgccaataccgaataacccattgaagaaccccgaaataatcatgaagagtccggctaaccaccacggataagtctgattcgccgcacgtttactcagactaaagtacccggccaacgaaactaacagcgcacctaataaccgtcgcaataactgcacatctaaaacttgaccaagatgtaccgaataggccgccacactggcataaacgataaacggcacaataatctgacgaaagtggatatgctgatgataacgccaaactaatgttatgacactagctgccataataacgcccgccacggccgcactttgagcaatcggaaacaactgtggtaaaaagatcatcatgacgatggccgcaccaaagcccgttaaaccttggaccaggccagccaataatccgggtaagaaaaccaataaccataccatcaacgtaccctcttttcatcgtaataaaaaagaaccgggtcacccagttccaacaaaatctaaatatgaattagtaacacaaaaaccatgacagagactagaccaatcaccactgataaagtcattgaacgcgtgcgataagccacaaatccaacgagaatagcagaaataatcatccccagattgccagaagtgatcactgcgtacttactatcgataaagacgctttttacaactaacgccgtgaatagtgagacgggtacgaatcgcatccattcattaaaccattctgggatcttccgcttcgtaaagaacagtagcgggaaaaaacgtggtatgaaagccacacacgcacaaaaaatgaccaaccaaaaatggtccatactactcattgagctgactgattgcataagaaaaacccctctgtgccctacttgtcagattcttccatggctgtttggccagtaggatcgtgaaccttatagagtaaatgactttctggcttatgtgccaacaagtaacgttcaataaagtaaccggtcaacgacgcgagtagtgttgataccactaatcccagcgtactcttcattaagaccaagaaaccaatcgttagaacgccagacaaaattgccactaagataatcaaacggctcttagtttgcataattgccatataaatgaatagtgccgtcagcgcaaaatccaccacttggagattaatcgtcagtgcactaccaatcaagctaccaataatattacttaccgtccaaaacaacaacgaatagtgttcgaccatcaaggcttgcgatggtttccaatgcttatccgttgcgaactttaagtagttgaccgcgtaattttcatcattcatcgaaaatgcaaacgtaaaaatgaacggtaacgattgtccctttagatagcgcgataagctggaacctaataaggcgtaccgtaactccaagaaaaacatcatcaaaataatggttgtcatcggtgcattaattgtcagcatcgatgcaattaaaaattgggcgccaccggaaaagaccattaccgaaattaacgccgtcagtagatggttgaacccggccgcatgcaataaaaccccacaagctaacccaatgggaatatagctaagcccaagtggcattactgttcgtaagaccactaaccaatttggctcgttctttttcaccaagaatgcctccagtaccataccagtaaagaattctagcaacaacagcgagcgtcaaattacttagacactcggacttaattttaacatgttttttattgcaatcctacaccttgttaagtttttaactgtatgtaagcggcatcatagctattttttatttgaaatgttgccccagaatcactaagtcattcggccggccgcctaattcagcgacttctggcagaaacccccactgttcgtacccaaactttttgaacagtttaatacttggcagattgctcgaaaacacatacgccacgatcgcagtcaatcccagcacaggtaacttttttggaatcatcgtcattacctgactccccacgccttgtccctgaatacttcgatccaagtacattgaaatctccgccgtcttcgcataggccgcccgaccgtagaatggcgataaactgacccagccaatcaccaaatcgtccttgaccaccacccacatcgggtaatgctcagacgtatggctcaaaaaccagtttcgccgctgatcaacagtcaccggcttgagatcagccgtcacttgatggctcggaatcgtttggttataaatatccacaataattggcaggtctgacatggttgccgttcgtaataatacactcataggtgactttcactccattcaacttaactactgctatcagtctttattatacatttaatcgtggatcatgctaacaaattcgacataaatcgcaccgccatttatgcttatcgtacgcattcaagtaccagagaaaagcctgtctttccaacaaaaaatcctctttgagtgggtaagccagtaatcagggctcatctactcaaagaggacaatatctttaaaaagtatctcgtagcgtttactaagctaatgcactcacagaatccaatacactaaccgctatatttagttgaaccagctcttaaccccacgccacatccgtacaaagatattcgctttgtcgatggacttcttaggcgttacattgacggtcatgttcttgctggtcgtaccgtcaactaccttgattgctttcttgcttaggttcaagttaacagtaccgactgtcttaccgttcttaacgggtgcttgtaatttgccatcggttgttgccgacttcttcaagctgaccttaccagtaacggcactagcatccgtcccggttggcaagtaaatcttggttgcaccactattggaaacgagttgcgacgttaaggacttcccatcttggacgtcaacggctttcacgccattgatcttgccattcttgttgattgtggtagtcgtgtagttgtggtaaacatatgacatgatttcagccgtttgagtgaaacgttccgtcccactatcgttagcggcgccagcatgcatgacgaccgtaatgatccggttaccattgctaaacttaacggtcccagtgaaggcattcccagccttagtggaagtcccggtctttaagccatccactggcagggcagagtaatgtttaaccaaccctttgagcatatagttccggttatccatcttagttgctgaactagtgcctttttcaaaccaagcatgcgcaatgctagaagtctttagtacttcgggataatctgataataacttttgtgccacggtagcgacgtcttgcgctgacatttcattttcagcactggacgcaacgttactataaccgatcgtactcccaacttctttgttggttaacccactggcgttaataatggtggcatccgtgattccccatgatttagccgttttccgcatcaaactaacaaatttatgtgggctcccggcaaccgcgtcacctaaggctgtgatagcggcgttagcagaatagatttcagtcgcattatataattgtcgcactgagtacgtcttcgtggatagtaatggcacgttcgcgtattccgtgttctgactcatcttagcgactgccttgctgacgctgatcttttgattccaagataacttgccttcatgaatcgccttaagcactaaatatgtacttaacatcttcgtcattgatgcgattgccattggcttactgctgttcttatcatacaggatctggcccgtcgacgcgtcaaccgcaatggcggccttcgcagaaatcgatggtgtgctggctgcttgggcctggagatcagcccccgcaatgcctaaaccagccgtagtaaatgtgaccgccgcaacaagggcgatcataactttctttaactttcccgcaaatctcatttctcaattatccctttcctgaatgctagttttagtttaaataattatgactgtggaaacaagttaatttatcatattcgattgtttttttgttaatgggtggtcatgttttactggcaaatgaataacgaagctcgtttgctcgtcgtcactctgcgcataaatgtagccaccgtggtgttcgacaatactttgcgcgatagctaatcccaggccagagcccccggtcgctttggaacgtgattcttcgacccggtaaaaacgttcaaataatcgacctaaagattcagccggaatccgctgaccgtcattagtcacgtggatgacgacctcctcaccccgctgctcagcttgtaagacaacattcttcgcgcccgtcccgtacttgaatgcattggtaatcaagttgctgaagacccggcccaacttttccgcatcagcctcgatgtaaatcggttgcgtgccgctctcaacttcaatcttcaggtgctttttattcgcttccaattcaaagctggctgctaactgttccaacatcgccgtcaggttcaatcgattgatagccaggggcgtctcagtttggcgtgacttagtatactcgaagaggtcttcaaccaacgacttcatctgtgtcgccttcaaataagcaatgtgtgcgtacttgactaggtcttcttccgattggtactgtttattctcaatcaggcccagatacccgatgatcgacgtcaacggcgtccgaatatcatgactcacattggtaatcaaggcatccttagaccgttcgatttcccgttcttcatccatcgaatgaatcgccgaatccaccagcgcgttgacactctcgacgacccgctgtgtgtcaccagtcaaattaaagtcgattcgatgatcaaagtggccggccgcaatataatgcaactcgctgataatatgccgtaattgcatctgtttgtaacgccgaatcagtcgccaatacaacacgaacccgtccgcaatcagcatcaacccgataaacagattttcatagctccagagctgataattgttggggccaatggtgattgaccgcttgatttgaaaaatcccactctgcagccccggattatgcgcgatcgtactattaatcagcaccacgatcgacaagtttaaaaggagtagcaaaattaccgttactaccccttcaaaaaacaattcacttttttcgcgtcccgttaatttcaaaagctaaccctcactcttaacgcgattcgatcttataaccaacgccccaaacggtctgaatgactttctcaccatccgtggcttcttcgatcttatcccgcaaatgactcacgtgtaccatgacggtcttagctgaaacgatactttcttgctgccagacgcgttcaaaaatatcatcggcagaaaagacccggttcggatgactcgccagcaaatataaaattccgaattctaacgcggttaattgaatagccttaccagtcaacgtcttaacttcgtgtgaatccttgttgatcgttaacggaccgatgtccagaatgtcaggctcggtggtcgtcacgttattttcagaacggcgcagtaatgatttgacccgcgccatgatttcaagtgggttgaacggcttggtcacataatcatcagcccccgtgattaggccctgaatcttgtccatatcacccgtcttggcggataagactagaattgggagttgggaatccttccgtacttctttgataacttcaatcccatccatttcaggcatcatgatatccaaaatcattaacgcaatatctggattcgtatttaatttagtcaaggcttcgcggccattataggcactaattggttcatagccttcgtttttaatataaatttctaatagttgtgcaatttctttgtcgtcatcgactactaaaattttcattttatttttctccttaaataattctatttttattttaccaaaaaaacgaccgggcttggcggttaacggttgattttagagaaaacgcaactattccccgtcattggtggcgcgctgcactaatagccaggtataatagccacctactaaaatcaccaaccccgctgcgacccaaatcgtccgtgacgtccaccaccgttgcaggatggcggaaacaatggcccccgcagcaaagctcaacactaattcccaatatacgaggccagtggccaattccgtacgcgcgccggtcaaccaatagtttgtcagcgcaatcgttgcctttttgagattgccggtagagaacacgttattatagccgtgaccagcgattgcgctaaaagcagtcgtctgcatcgccatcacgaacgcgagcggcgggaccaccatcgcattactgacagtcgctggtaacataccgaccatcaagcaaacgacgagttccgctatcaaaattggcaaccgccaataatgcgagcgggctcccaatcgatgttcgagtagcccaactagcgtgacaccaataataaagaaaatgaccgttaccaacttagtcacgacgcctggcaaatcgcgacgggccacatcaacacttagaaagatcagattgcccgtctggccagccgctaacactccgcctcgctgcataaacgtgtatgcgtcaataaagcccccaatgaacgtcagtcctagcccaatttcgcgcaattgaaacaaatggcgtgactgaaaacggcgcatctactcacccacttttgcatcattaataagtccatcatagcgcatccaccgctgttggcctaataaaaacgcgtatccggctctgaatcggctcggatacgcgttctagttaagcgttcggattaaattgtttcatggcagcttgtaactcagccaacttatcgggctggaccatggctaagaattgtgggatcacttgttgcagttcagcggttgaaaatgttccggccgcctgttgctcaaaacaacgattcaatagagcttcagcctcactttgcttagccggtaacacccgggccatcaagaaatcatgaaactgtttctgaccagcatccattcatcaaacttcccttcgtccaagatgcccatagcctaccatacggccaccgggctgcctagtaatcggacttataaaataaggtatgctaacctgctgtcagcataccttatgtgtatttatttagccgttaactgagtagttaggcgcattcttagtaatttggatttcatgtggatgtgattcccgcaggcccgcaccagagatttcgacgaactgggcgttttcaatcaaggcatcaatgtccttagcaccaacgtaacccatcccggaacgtaagccacctaacatctggaagataatatcattaacgctacccttgaatggcacgcgtccttcaacaccttctggcactaacttgttggcttcgttgacgccaccttggaagtaccggtcagaagaaccgtgggcttgtgacattgccccaacggagcccataccgcgatagaacttgtactgacggccatcatcaaagacaacctcaccaggagcttcagtcgtcccggctaacatactaccaagcattacggcgttaccaccagcagcgagggccttaacgatatcaccggaatacttgatcccgccatcagcaatgatagctttgccgtattcgcgagcaacgctggcagaatcataaaccgctgttaattgtggcaccccgacaccagcgacaatccgggtcgtacagattgaaccagggccaatccccactttaacaacatcaacaccagcttcaaataaagcacgcgtgccttctgccgtcgcaacgttaccagcaatcaatgtctgcttagggaagtgggcccgaatttccttgatcttccgaagcacaccagcggaatgaccatgagccgtatcaataacgatggcgtccgcaccagcggcaaatagggcttcagcccggtcaaaggtatcactagtgaccccaacagccgcaacggccaacaagtgattgttggcatcaacggcagcgtgtgggtgatcatcatccttaacgaccgctttgatcttcttaacttcttcagcctgcgcttcaatgcttaagttcttatggataacagctaagccaccttggttggccatcgcgattcccattgcggattctgaaacagtatccattcccgcactaataattggaatattcagctgtaaattatcggcaagtttaacacctaaattgacttcattcggtaaaacatgactttcggccggaattaatagtacatcatcgaacgtataacccttttttccaaactttgtatcccaattagacattgaacgttagctccttatgtttttatttttatctgtaaaggtaacaaaacatcgcgataaatgcaaggggttgcgcagattttcagaaagttcttattttaagcctgtaacgcccaaccgaatgttccaggttgggccgagcgtacttcacacacaactttcattcagtcattacatccgtatcatcagtttaaaagctaaccagatgaagcacaagcaatgaccactcgcaatcgacaaaaagacaagccaatgcacgccatcagcttgtctttcaatccgagcctaaaacatgctcgtcgtaatattaaagcgccgcttcaaccacatccgggcgaagaagacgacgacggcaatgatcaagtacgcgattcctggtaagaccgggttcaatgggccttgaatcattgacatggttgtaaagactagcatccaaatgatgatagccagtactgaccacgcgattttcttccataacgaaactttcttgccatccttagcaggcattaagtattcgaataacttagcaacgcccaaaccaccaatggcggacgtaatcagaatagcggtgatcccgttggcaccagctgaattcttagtagcgttcgtgccgatgaagcccatgatcccgtacattaagcagaagatcatgaatagcatcaagccattatccagcgccgtgacccagtagttcgccttttgacgttttaccggtgtctttttcggattaacgatttcttcggtccgttcttgaacggtcccgtataattgacgagccgtggttccccgaccttgttccgctaacaatgtagacgtcatttcattcagaactgccgtctttttctcaccactcaacgctgtggcgtcaagggacttgcgcatctgacgcatatattcagcattgcgcttcgtcaactcagtcgcttcgtgaactggccgttctgcggcttgggcctgcttggccccggccgcggcgttcctaggtgtctttgaagtttcgctctcactcactatacaattgctcctttcagcttaaaagttgaagcggaattcgacgatgtcaccatcttgcatgacatagtccttaccttccaaacgcaacttaccattttccttgacctttgcttctgaaccggcttcatccaaagcatcgtaggacatcacttcagcccgaataaatccacgttcaaaatcagagtgaataattcccgctgcttgaggggccttagtaccgcgtttaaacgtccaagcccgggtttccttaccaccagccgtgaagaaggtttccagtcctaatagcttgtaagaagcccgaatcagcttattcaaaccaggttcctcaacgccttcagctgctaagaagtcagccttgtcatcatcatccaattcggcgatttcttcttcagtttcagcagcaacaccgatggcttgggccccttcttgcttcgcatagtccgcaactacttggaaatacttggagttttctggatcagccatgtcatcttcggcaatattggccacgtacagcactggcttagacgttaataagaataagcccttgacgatttgttggtcatcttcgttaaattctagtgaacgcacgggtttgccagcttccaaggcaggcttgatcttttgtaaaacggcaagttcagccttagcttccttgtcactccccttagcagctcgttgcactttagccaagcgcttatcaacggcttccaagtctgccaaactcaattctaggttgatggtttcaatatcatcttgtgggtcgactttacccgtcacatgggtgatattatcatcgtcaaaggcccggaccacgtgcacgatggcatcaacttggcggatgttttcaaggaacttgttcccaagtccttcacccttactagcacccttgacgatcccggcgatatccgtaaattcaaaagtcgtcggtacgaccttctttgcggggataatttcttgaattcggtctagtcgtttgtcgggaacttcaaccatcccaacgttggggtcaatcgtcgcaaatggatagttggccatttcggcgcccgccttcgtaattgcgttaaacaatgtggatttaccaacgtttggtaacccaacgatacctgctgtaagtgccatatcggttattcactcttcctttttaaataattaagcttgatcggctttgctttctaatacttttttgagttttttattgaactcacgacgcggcatcatgaccacgtgaccacatcccgtacatttaatcttaatgtcagcgcccatccgggtaatttcccagcgattgacaccacacggatgcgcctttttcatctcgacaatatcacctaaatcatacatgcgcaacgcccctttataaattaattaatttaaatcaatactgaggatttctaaaatccgggtcaaatcttcattcgacaagtacgggatttcaatctttccttgattagctttgttcgccttagtttgaatcgaaacggccgtcccgaacttctcttgtaactgttcctcactcgctcggatatacggtgacttcttgggtgcgacttttttagccggttccttcgtctcgccgttataacgcgccacgatttgttccaactgccgaaccgtcatgctgtccttcaccacacgcttcgctaacggtgctagcttagacttatccttcaaagacaagagcgttcgagcttgacccatggacagttggcccttttgaatatactgcttgaccccgtctggtaagcccaataaccgcaaataattagcaatatatggtcgactcttaccgaggcgcttagaaacttccgcctgcgtcaacttcagcttcttcatcaatgagtcgtaggccgctgcttcttcaagcggagttaaatcttcccgttgtagattttcaagcaccgctacttccatcatttgttcttcggtaacatcacggacaatggcaggaatggtcgtttgatgagcgagcttcgacgcccgaaaacggcgttcaccagcaatgatttcatatttattcagctcggcatccggttgacggacaatgattggctggaaaacaccagacttttcaatcgagctagcaagttccttaagcgccgtctgatcaaaagtccgtcgtggttggtacggattggcatgaatgtccttaagatctagatcaaccacggcctcttcactagctggttcgttaacatcagcaaacagggctccaataccgcgtcccagcgccttattatctttatctttacttgccatgagcggccaacacttcctttgctagagctaagtagacttgcgcacctttcgaacgggcatcataatcgacaatcgataggccgtggctaggtgcttcagataaccgcacattgcggggaatgatcgtcttatagacggcgtccttaaagtatttccgaacttcttcgttgacctgggctccgagattggtacgggcatcgtacatagtcaatagcacgccttcaattcgcaactgtttattaaaatgtttttgtacgagcttgatcgtattcaataactgactcagcccttccaaagcatagtactcgctttgaaccggaatcaaaatcgaatcacaagccgtaaacgcattaatggtcagcaagcctaacgacggtggacaatcgatcaaaatataatcataatcatccttcacgtcatcgatggcatcacgtaagcgggtctcccgtgccatcatcggtgtcagttcgatttctgccccagaaagctgaattgtagccggaacgatatctaaacccttatgactcgttgggataatggtttctttaatgggaacgtcattgattaaaacgtcatagatttcacgttcgatggtcgacttttgaacacctaaaccactggtcgcattcccttgcgcatccgtgtcaattaataaaactttttggcctaattcgaccagactagccccgagattaatactcgtggttgtcttgccaacgccacctttttggttagcgagtgcaattacggttcccataattattgatcaccccttggttgattttttggaatttcaatcgtaatccgatacccgtcatccgtatcctcttcatgggtcttcacgggtaagccggcatcagttaccatcttaattgattttttgatcgtattcacagcaattcgcgtatcgccggtcaacccccgtgcacgtttgcgtttgggcttcggcggcgtttgggtcttcgccactagctgttctgtttctttgaccgtcaattgatcagcaagcacccgtttcaaaaccgcagcctgttgctccacagccaagttgagtagtgcgcggccgtgccgttcgctgatttgtcgctgcaacaacgccgtttgaaccggctgtgctaacttcaacaatcgcaacttattcgcaactaacgactgactcttgcctaattctttcgccaacgccgattgcgtcaactggttgagttccatcagttcctgataagcccgagcctcttcgatggccgtcaagtcttgcctttgtaaattctcaatcagcgccattgacgcggtttcaccatcatccatcttttgaatgatggctggcacgtccgcccagtgcagtgaagatatggcgcgaaaccgccgttcaccagcgatgatttcgtatttttgcggttcatactcccgcaagacaattggttgcaataagccgtgatccgcaatcgtcgtcgctaattcagcaataccagcttcatcgaagacttgccggggttggaaccggttggggataatggcagtgaccggaatacggacgatctgttggtccgtgggggtcgtggccgcctcggctttatgtttatcacgattagaaccaaataatgaaaatgccattgaaattacctcccaccttacattggcgccgttaacggctgttttgctggtgtccccggcttgcgtggataccgcttcggtgacggcttcttcttatcaataacaatgatatggcgtggatcagcggtcactggcaaactgaaagcctcatcctgaacgatctggccacctaattgttgaacggcgtatgttccctcggccgtctccgtacgggcattggctgctttcaacgcaatcatctggccaccgactttaacgagtggcaggcagagttcgctcaatactgataagcgcgccactgcgcgggccgttacgacgtcatagctttcccggtgagcagatttcttcccggcgaacgtttcggcacgatcatggaacgtttgcacgcccgttaaacctaattgttgtaccaggtcattcaagaaattgattcgcttattcaatgaatcaacgattgtcacctgtaattgtggaaagacaattttgagtggaatcgacgggaagccggctccagcaccaacatcacaaatcgtgagtggttgatcacgcaacgcaggcacgtagaatgctggcgtgagtgaatcgtaaaaatgtttgagataaacttccggttccgccgtaatcgtggtcaggttaaactgcttattagtcgtgaccaatagctgaaaatacagcgcaaattgtgccaattgttgatcggtcagcgcaatctcatgttgggctaacgcttgcttaaattcttctggattcattagtaatagctctccttaaaggggtcacattcgtcctctttttgtgaaacaactcaatgtttcacgtcacctcataactttaacgtaaatagcacttaaaatcaatgcacagccccgccgtcaaaatcgcaataacccttgaaaagtctgcttttgcagctatcattgattgctattctagtttgcaatttttctagtcgaattcatgaacggccttgaatattttgccattaaaaatatcctcagactcaccgacgcctcaattatgcgttaataaaaaaagaggccagctaaaaaggctgacactcttaggtttaattcaagattcaattatatcgtcgactaccaaacgaacagcccaacgacaccggctgataataaggagacgaggattccagataatagcatgtaaccaacgttccgtgagatcaaatcgttcttttcacggtcaacgattcccttgaaggccccgataatcatcccaatcgttgagaagttcgcgaaggacgttaagaagaccgttaagactgcccggaaatgcggcgcaaaatcgtttactttgctggaaacctcacccatgacaacgaattcgtttgtgactaatttcgtccccatatatgaagccatctggaaagcatcactcgggttaaagccaagtaaccatgcaaatgggaacatgataaccccaaagatgttttcaagggataagttactattgatcaagcctaataacttatcaattaatttggctaacgccacgaaagcaataacgttagcggcaataatcaagatcaagcgaccagcgcctaagattgaatcgcctaagaaagagaagaatggttcgcgggctggtttagcttccttaacttgttcgttagctaattcttcagaaccgctcgtttcagtggtggcagtagtttcttcaacagccgcactaccagagatttttgcaatggtatcttcttccggcttaacatcgaccggattcaagattgccgccacaatggccgcgttcaagacgttcattggcaccgccgtcaaaatgaattgaccaggcatcatcttaatgtaagcccctaaaattgatgcggtcacacaactcattgacatcatcgcaatcgtcaagtttcgttgcgccttcatctgcttcaattgtaactgcgaaacagcgagggcttccgtgttacctaagaacatcatttcaacaacgaagaatgattcgaactttggttgaccagtaatgtaagctaacccccggccaacccatttgataatccatggtaatacgccaatataggttaaaatatcgaataatggcacaatcaacaagattggtaataatgaactagtgacgaagtccatcgacttaacgttgacccaactagctaacgcaaaggcgatcccatcatatgacacattgacgagccaagtgaagccatctgccgccgctttaaccgcgtcgacaccgacttgtgaacccgttaagaaccatgccaataagacttctagtactaacatgacaccaactgaacgccagttaatggcgtgcttttgcttggagaataagtaggcaatggcaataaaaaccacaatcccaataatattaactaccaagttaaagaccatgtgaataatccctcttccctatgaatgtaagaaatatgacaaaactacttctattaatttaccatttaatacgcgcttgcggtagcactttttaaagaaaagcttaagttcttaattaggccgtaccaatttatcgaaaggccccgtccagatagtgctggtaaccgcgggaaatttaattatacttgcccgatttcattctaaattttagtgagtctgccaatcaagagttaaagatttaggcccatcgtgattaaccattaacttattatgactagaattaatttattaactttccagactaatttcactcccagaatcgacgattaactgcaataacgaaaaaaggtgcccgactaatccgtcgatgcacctcattcaactgaaaattcagttattaagtaccccgcaactgcggggtgcccctgccaaggagttctattataccgcgtttagtccgtttgcgaactaattagttgacctgaccactaaatggggctaaactacggacaattaatgaaagggggtgatgctttttgagtaccatatgtaatcttaaagcatcagtctctgccctattcggagcacatgactgatacctttaaggagtcccgaccaaatatacttggtcgggacttttgcgttttaaaagtgtataaacagttgcaagttgaccgtgactagcttacattaaaagtgcagtttatttggagatatggagtaacgggaaatatgaaagcaacgacaaaacaagtattgacaggtgccgcctggctcgcaattttgctggcaatgattggcggtatcatgttatggcaacatcaagttcataaagcgaaaccggtcaccaacgtaaccgtaacttcgacggaacgcattccgatggtactcttattagataaccgcttaactcacaaccaggtccaacagttaacgaccaacattcaaaacagtagtgccacccaaacactggtcaccgccaaaataactgcgacgggagccgtgacattcaagggacaattgctcaacagtgacaaccgaccctacatacaagtacaactaccccaaaatgttagttccaccctgcaaacgcaattattaaagcaactcttgaccactgctcagcagcaattcaagtttcgccagtttaaccttgtcagttatggtcgtggcggcatcattgccactaactatgtcgcacacacgacaaccagcttatccccacaacaccttgtgctgatggccaccccatttaacggcatcagccgcaaaaataatagtcggcgcaaaacgacaccagttgccgccaagtcacaaacgactacactagcgaaattgattgcgcaacgccataccatcgatgccaagatacaggtgttgattattgccggcaaagccatcaaggctgaccaacccttaccacttcaaagtgccctggccggtcaatctatcttcaagccagtagtgaaagtctatcgacaaaaggtgttgcgctcatggccaacccaatccggcttactcaacaaccaccaaattggcaatacgattcaaacatttataaactgatttcactagctcaatcgacctcgccgtcatttttgctcggcgtgctgatctaaaaacaatctaaactatcaatagccacctttccagacaaccaactgggtcttctggaaaagcggctattttttcactatctggtcagagtaagtttttaacgctaaaaatcgctagctacgacccactggaaagattcggattagctcaccatgcttagttggttcgtcctacgccaatgctctacctagctttgttactgccacaacatctgatccgggtactccttggtcaaaaactgcttaatggcccggatcatgatagccgtcgaaggtgcggtcgcctgcgtttttttggcaaccaaggcaatttcacgattgtagggttcggcaaaggagaacgtgttgacatcaccagttagcttccgtagtgctagctggggcaaaatgcccatgcctaagccggattctaccattgaaataatggattggtcatcaatcgagaaacgcaaaaagttattcgtaacgtggtagtgatccagcgctagcttggtgtcccggtcataatcgctttgttgtagaataaagttcttatccgcaacatcatcagtcgtgatgaattccccgttttctgggataaaatcagcgggcgtcacgcaatagattggatcattgatcagcgagtgcaccagcaagttctcattgactggcatcgacgtaaacccaatatcgatggtcccaatcttagcccagttggttatttcattaaaatcaccttgcatgactgaaatcttaatatcaggatatttatgattaaattcgcgaataattcggggcaaccagttgatacaaacactactgaaaccgccgatccgtaccgatccagagtgcaatccttgaatattatcggcaacttgtcgcaagttactttccgtattcagaatctcttgaacatagggtaaaacctgccgcccatcactagtaagttcaacgcctgaacggttacggatgaatagcggaaaacccagttctttttccaactgattgatcgaatgactgaccgcacttggcgtaacgttaagcgtagcggccgcttggtagaatgtgtgttgcgcaacgaccgttgaaaagacttcatatgcgaagtttgccataatgatttacctctcttaggtgaatttatttcacttattattgaaaaagttgagttttactaattacaagctttattttatcatattgataatcaaagaaaacagtttaagtacaaaaaactgagtgggggaaaattattatgaaaaaattatttgcaaatcgcgtgttaaacaatgacacttccgacctcgatgaagtcttcaagaatagtgcaaacccggaaaacatttccttcgctggcggttttccagatcagcacttattccctgacaacgacttaaagcaagcttattgtgatgctatcgaacacgatggtcaaggcatcttccagtactcatcaactcaaggactaccagcattacgccaaaaaattgcggatcgaatggcaactcacgctgacgttcaggttagtgccgacaatgtcatgatgacccaaggtggccagcaagccatcgacctcgtggcaaagctcatgttgaaccatggagatgctatggtcgtcgaaggtccgacttacatgggggctttagccgccttcgacacttacgaaccgacttactacgaaattccggttgatgataatgggatgaacattcgtcaacttcgcaaaaccttgaaggcgcatcctgaaatcaaattaatttatacgattcctgacttccacaatccaacgggtacgacgatgagtgccaagcgtcgtcaagcgctcgttgcccttgccaatcagtacgacgtcatcattttggaagacagcccataccgggacctccgttacagtggccaaagcattccagccatcaagcactatgatactgagggccgcgtcatcttcatctcaagtttctcgaagattctttccccagcattacgaacgggctggattgtcgctgacgacatgatcatgcacgaattggtcggacttaaatccgcaatcgatgttcaatcacctaacgtcacacttgctgcaatcaacagctacctggatcagcacgacatcgacgaccacgttgctaccatcagcgcttcataccgggttaaacgtgacgccatgctagccgcactcgatcaatacttcccacaggatgtccactacacccgtcccaacggggggttcttcatctgggtgaccctgccagaagggattgatgcaaaagctttgctcaatgacgtggttttaccacaagcacacgttgcttacgtgccgtccgcttgccaattcgcaagtcgcaaggttaaaaacgggttccggttgaatttcactagtctcgacgtcgaaacaattacgctgggaattaaacgcctcggccacatcttacaaccggcgccagtaatcgttccggcaacctcatttgcaacccaattctaacttgacccactcagcatgcgactaatcggagtaattacgattagtcgcatttttttgattatatctatcagctgtaatgagtgatcgtgctcctggatatctacgcttcttatatcaggattcataccgaataagcagcacgctttgtaaccatttatactatattagtttcaaggtccgcgtttgcgttacttttaatgataaaaagggtttgacagcccttctttgattcgctacactaacgctatactagccgattatgaaataagcattggtccgtttgcgacactcaatgcttattttttgttaacagcttcattttcggataaactaggagtgttgtgaaaaatttctaggagtgtgaatcatgaagtcatgggttaaaaaattaggcgttgcagtacttgggctaggtttagcagtaacattgaccgcctgtggtaacaacactagtagcagttcaaagtctaacgacctcggattgcaaaaatcggggacgttgacgattggcttagaaggcacttttcaaccatatagctaccgtaaagatggtaagttaactggttttgaagtcgacctcgggaaagctgttgccaagaagatgggattaaaagctaaattcgtgccaacgaagttcgattcgttagtagctggtttagacacaaataaattcgacgttgtcatgaataacatgtccgaaacggcggcccgaaagaagaagtatctcttctcgaccccttacatttattctaaatcacaattagccgtcaagaagaactcatcaattagtaagattactgatattaagggtaagaaagtcgccgagacaacgactagtaataacgcaacggatgccaaacgtttaggtgcaaccatcaccccaaccgatagtttccaacaatcgatcgaccttgtctcacaaggccgcgtcgctgggaccattaactctcgtgaatcgttctacgcttacttcaagcagaatccgaaggccaacattaagatgatcgattccggtgatcacattgcctcacaaaaaatcggggccatcgtcactaagcaacaccctaagatgcaaaaacaaatctcgaaagcaatccaagaattacgtaaggacggtacgttaaagaaattgtccaataagtattttggtggtaacgttactgataagtaaagcaccattgcccgctgttatggcgggatacatagcaccaaattctaatttgttacaggaggctccctatggattcaatctggcacatcattgtcacatcaacgccgcaaattgctgcagcgggcttaaaatataccattccgattgccatcatttcatttattctcggtttgatactggcgatttttacggccctcgtcaagatttcgactcgtcgtggttggtttttaattctgaaagccatcgctaacttctacgtctggctctttcggagtaccccactactggtacaactctttatcgtctatttcgggcttccctaccttaagattaaaggaattttcccaaatggggtccagctcgatccctggaccgctgggattgccactttttcactgaacaccggggcttactgtgcggaaacgattcgcgccgcaattctctccattcctcaaggtcagtgggaagcagcctactcgatcggcatgaccaagtcacaagtcctcaaacggattattttgccgcaggctgcgcgggtctcgttaccgccactatccaatagttttattagcttagtcaaggacacctccttggccgcttcaattacgattattgaaatgttcgaagtcagccaacaaattgccgctcaaaattatcaaccgctcgtgatgtactccctagttgcggccctatacgcaattctatgtacgattctcagctggctacaaggctacttggaaaagcggacgtcacgttacttacggccacttaattaggaggttgtcgaatgatcaaattagaacacttaaataagacgtttggcaatcaccaggcgttaaccgatatcaatactgaatttaaagaacaccagacgaccgtcatcgttggcccatcgggttctggtaaatcaaccttactgcggtcactaaatttgcttgaacggcccgaacaaggtttataccacttcaatgacgaaaccatcgactttgctaaaccgttgactaataaaacgattctcaacattcggcgtaaaaccgggatggtctttcaaggttacaatttgtttccccatctcagcgttgttaaaaatgtcatggaaggccccgtgcaagtcttaaagaaggatcccgcgacggctaaaaagtccgcgttagaattgttggcccgggtcggtttgcaagataaggccgacgcttaccccgaacaattatccggtgggcaacaacaacgggtcgcgattgcgcgctcgttagcgatggatcccgaattcatcttgttagatgagccaactagtgcgctagaccccgaactcgaagctggtgtgctccgcgtgctactggccctcgctcaggaagaagactccatgattatcgtcactcacaacatggaatttgcccgcgcagttgcggataagatcttatttgttgaagatggcaaaattctgttcgacggaacacctgctgaattctttaagcagccaacgcaacgcatcgccgacttcttagccgcgatgacgttcaccacgatttcggacaaagcaaaccaatagcattcatttgagttaacgtgcatctaactggaaaatccagtcaggcgcacgtttttttgatgagcgtacctcccacgctttctgaaaatgacattttaattaacgaaaaatgtgattttgatttgacaattattatatagtcttgtaaactgacctcaatatctaaacgttgtgatgagatgagtagtgtgattgccacgcaaagcgagccgttggttggtgtaaaacggtcggacagtgacacgaagatggtctctaaatggtattggtgagcattagcaagccagtaacgcgtcgtacccgttagcgtactgagtgaataactcattgagccaagcgttgtgcacgcgcttggaaactaaggtggtaccacgatcagcagtcgtcctttttcgataaaggacgactttttttgtcaaaaaaatatagctctacgggggtaatcgatatgaaaaaatggctcaaagcagtaagtttaacaattttaggactcgcattaacagtaaccttgacggcctgcggtaattctagctcatccaaaaacagcacttctagcacgagtagtcagctcaaattgcaaaagagcggcacgctgacgatcgggctagaaggcacctttcagccttatagctatcgtaaagacggcaagctgactggttttgaagtcgaccttggtaaggccgtcgctaagaagctcggtctcaaggcaaagttcgtcccaacgaaattcgactccttgattgctggcctggatgtcgacaaatacgacgtggtcatcaacgatatcgccgaaactgcgcaacgtaaacaaaaatacctcttctctacgccttatatctactccaagtctgaattagcggtcaaaaagagttcctcgattaacaagatcacggatatcaaaggcaagaaggttgcccaaacaacgactagtaataatgcgaccgatgccaaacgcttaggtgcgaccgtcacaccgaccgatggctttcaacaatcgatcgacctcgtgaaccaaggtcgcgtcgccggaacgattaactcacgagaagcgttctatgcttacctcaagcagaatccaaaggccagcttgaaattcatcagtggtggttcagaaatcaaaacgcaaaagattggcgcaatcgtcactaaaaagcacgccaagcttcaaaagcaactgtccaaagcgattcaagaactccgtcaggatggcaccttaaagaaactgtctaataaatactttggtggtaacgtcacgaacaaatagccatcgcaatcgatttgatagcataccgtcgatagtcacacaaaaagcccggaaagccgggctttttgtgtatgttggcgtctttcagcgaccatctttttatcactcatcgtgttgctaaacaccatccgggaccatttaaccccttgcctatgtcgcgagccggtcagctaattcaactgatttgcaatattgaatttcatcctgccatgattgacttccaaccacatatatttggtattcttagacgacaaaacctcaatgtgtgaatatttttgattgtggttcttcgcgatcttttcagaacgactttgaagtgtcgtcgctagtgactgccacgaagcggtcttgccctgatcgacactttcaataactggcgcttgctttgatatccgcacgcgcatggcactaccattccaactcactttaaccttgccatattcggctttattcgcacggatttctgattggatattggccgcaaccgcgtttgcttctttagcctgatacaaattaaacccgatttcaaagacgatgactagcacacagacaagtggtggcaaccaaaaccaccacgtccgtatgctctttttttgatgatgcggctgctttaaagtcgtcgtttccgcgtctttacgcttatcggcagcaactgtcggttgtccactgccgcatttttcacaatactgggcactttggggaattcgttcaccacaaaccacacaattcttcatgtctgtttccataattgccctccgtcataatattatcgataataattaactcagccatgacaattaactgtattaatatttcaatataatgattatatatcgaaatcagtcatttttctaggccttatcagatcagtatagtatcacccttgcgtaccggacagctggtattcgctgagcatcatgattttaagctttagtacgggcctatttcagtcaccgttagcaagcacgttttgcgtttactagtggctaaaagcagtttaccttttatcattattttaatatttaagtttgacagttagtttcacttcaatgtatactactcattgagcaatactatacgacgtataatatagtaggagggatagcaatggccattcaaattagttccgagttattggacgggtgcgttttagcctgccttaaaaatcaagattattatggttacgcactaacgcagcgcttgcaagccgccatctcggtgtccgaatcgacgctctacccagtgcttcgccgactcaagaaaaatgactgggtcacgacttacgatcaggcctttcagggccgcaatcgccgctattatcaaattacgagcgccggcttgacacaactgagtgcgattcaacaagagtggcaaacctattacttggccattaaccacttacttcagggggaggatgaaccatgaacgactacttatccaagtttaacgcgttactcgttcaacttaccgatgatgaacgcgacgaggtcgttgaattttatcgcgaatacttactagacgcggcaatcgccaattatgatgactgcgttgccgaactgggaacgcctaaacaattggctcggaaagtgttagccgattattcgattcgctttaacgaaaatctcaacgccaatacttctaaacggcaaaagtcacaagcaaacgtacgcacgatttggctaattgtgcttgctttattatcaacacccatcacaattcccgcattaatagctattttagcggtcttctttgccttggccgttaccgtctttgcattcgtgattgcagcgggtgccatcttaattggcgtaaccatcctcgcatttgccatgctaacagccggcatcggtatcttcggccagtcgctatgggtcgcactattctacctaggtagcggtcttgccattattggcgccgaattattagttctaccactatttatctggttgattagtctcattttgcaaggaattgccaaaatcgtacaaaacttataccaccgatttgttaagaaaaaccgggcggaacgagggggtcggcagcatgcgaaggacaattagagttggcattattttattagttgttggactgcttctaatcatgtttggaattgccaataacggtattcaaagcgtctattgggaccagggctttcacattgttcgccataagacgcggcgctaccacgtcagtcagctaaaagatatcacgattgcaacggccaacaatattactattaagcaaggcacagctgctaatatcacggttaccgccacgcgcgccttaccaactgttacgaccaacaatggtcacgtcactgttacttcaacgacacacaacgccaaaaccgtgggcttcatgttcgataacgtcggacaatttgctgacacgacaataattacggtgcctaaaggaactactattcatcaaataaccgccaaagctagtcaaagtggtaacgtttcgttgcaaaacgtcaccgtcgaccaattgaaaagtcttagtacggatagcgatattaatttaacggatgtcaaagtcaatcagtcgctgacgttgaccggcgataatttacggttaactcgtgtctcggcgcctagtctacaaatcaatagcgatccagatatcagcatcaccgacagtcattttaccaagactgcttcaaaaattataaccgctgatagcgacatccatctaaccaataatcagttcaaagcccttaagctaacaagtagcgaaggtgatattatgctcaataataatcgcatcactgaaagtttatccgctacagccagtgacggtgatattcgaataaccgcgccacggacaaccggtgttaaagctagcactagcgatggtgacttgcgcatcttcaaccacaccctatccgatggcggtgagtaccaagtcaaccagtcagcagccgtgcaataccgactgacgacgtctgatggtgatattacggttagtgcgaagtagccctactcacgctaattgcaccagcattaactacaccatttcaaatctaaaacaagcgttcaaaactgtcattttcacacagctttgaacgcttgttttcattatttgggatttaaaattagtacttcctgtttatccagtcacacctgggcatttcatctgacaatcgtctgcttaaaaagtgatgatatcaatcgcaactagcattttaaaaatgctgcccccctcatcactttttatcccattatgtccggctcgttttctaacaaccaatccacgatattaatcactgggattccatcaatactttggatttcgggatagtgacgttgcgtaatcaacaatttatcataattatcgcgtaattgtaataaattatcagtttcgtgtgtattatatggaacttcataagtaacctgcacatacaagatacgatccactttacgtgcaacaaaatcaattttcttagtattcatcttaccaacatcaacggtgtaccctcgccgcaacaattccatgtaaacgatattctctaactgacccgcataatttcctggacgtctcccagttgccgttcgccgcaatccaggatcgacgacaaaatacttgccagccgttcggagatacgttttgccacgaagatcgtactgccgggaacgataaaataaaaaggcatcttccaataattgcagataattttcaacagtatggttgctaattgaaatcccctcgctcttcaaaacgcccgcgaccttagccggtttgactaattgcccgatattatccgccaaaaaagcgaccaatgctcttagcgactcgatatcacggacttttgcgcgttcagcaacatctttaagggttatcgtatcgtacaaactggacaggattgcatctttcagttccacttgacttaacgtgactaatggaaaaccaccatatttttcatattctatgaatgcctgatcaatttcacgcgaatcagacgtgatcttcttagccgcaagaaactctttaaacgaaaacggataaatcggaatttcgacgtagcgcccactcaaaagcgtcgccaattcaccggataacatcttagcattagaaccagtcacaattatgtcacagtcatagctgacccttaaaccattaatcaccgtctgccacccatcgaccatctgaatttcatcaaacatcaaatattgatgaagtgtcttgtctaacttcggcgtcaataccgcaattagtgcttcagcagttcgaaccgataataattctagttcttcaaaattcaagtaaataatttgttcatccgcaatatcttgtgatttcaaataatcacgatataaccttaataatactgacttaccagaacgacggacaccggtaataaccttaattaaatcagtatcacggaattgaatgagcttatttaggtatgcatcacgttgaatcattacagcacctcgcaaaattatcacaactcgtaatcagtatttaatggaaatatacttccattatatctggtttgttttaaaaacggaaatatacttccatttttgtcataaaagatcaaaaattgcagtatgtttccatttttctagtaacgggcaacgccccatgcacgaacatccggtttaaacgatggtttttacagttactttttaacattctagccaaaaaatattccaagtcagcatccctctgacttggaatattttaattactgattcagccttagtaatcgctataacgatgcttgatagacatcaaaccacgtcaataatagcgacacaatcaagataccaagcatcgccaccgcgtgccaccatttatttcggacaaatatcgcaatatactcacgaatgatcgcatccggtaagaagaatcgagccgtccgcgcaccaataccatccgcttttagacctgcttgcttggcaaacatcccggctctaaaggtatggtaattatttgtgacaaaaatcgtacgtggctttttaacaggcccctgcgcaatcaattgcttactaaactgcatattttgcaaggtcgtcttcgattgcgtctctgcccagccatccgtttcaggaaggccatgtgcgatggcatagtccaacatggcttggccttccggaaccgtttcgtcaccaccctgaccacctgagaagatcatcacggcccgatgatgcgtcttgcgttgttgcttctgataaaagcgcagtccacgcatgattcgttgccctagcagtggcgagactcggtcaccgtctaacaagccggctccgagcacaataatataatcttgtcgcagccggggccagttgaattgataaatcgtcagcatcgtcagatagttataaaaccaaaaagcaaggtacaaaatgaccagattcggaaataccgtcaaaaaataactcacgggctgcggcacatgactactcaacagattgcctaaaaatggcaaaatcagaatggccagtcccaagtacaaagtcagcatattcgccaacgtatgactctcatgacgccacatgatccacgcattccataagagcaagaaggcttgtaaggtaaaaatcagcccaatcaacaggatcagcaacacaaacaacgtcccactgataatgatcaaccagtggatattgctacctaaaattgtgattgccagcataagcaaaaacgagtagaaaaatagcgaaaaccaaataccgttacctaggcgaaccttatcgcgatgataacgccaaccgaaaatggccccaaacgtgagtggtactagccagccccagtaaaacatcactggaattggaacccaaaccgctgcgtcattcacatcaacacccccgcattaagttttatttcagcttccatcataaaggactccccgcgggactgcaatcaggagtcattacttcaactgtttttgttcattatagaaattacggtaagctaaatagcacgcaatgattgaccccaaactagtcgctgataagagcatgaacgtgaccataatttgatacttaatggcccgtactggatcgacccctgcaaagatcaaaccggacatcatcccgggcagactgactaagccgactgttttggccgaatcaatggttggtgacattcccgtacgaatcgcctcacgcacgatggcaatcgaagcatcgagtaggccggcccctaacgctaaccgttcaagcacaccttgccgctggtcatgaaactgactattaaggctacgataagctagcccaattgcgaccattgaattcgacgcaatcatcccagagatgggaatcatttgcgatggcacaaacttaatcgcaccggataggacgaggacgccgagcgttacccctgtactgacaaaaatggctaatagtgaaatcgacaaggcgtggtcaatccccggcccccgttttttcgcattccaagccgcattgaagataatgaagcccatcatcgccagcgttagccacaaattgttgactcggaaaatatactttagcaagtaacctacgataaatagttgtacaacagcccgcacgacaccaatgacgatgtccttatccaagccaagtttctgccacaaactaattcctaacgcgacgagcactaacattgccgccaaaaatagcgacgtattattaactgctaaattcatgcgtgtacctccaatctgccagcaaccactttcgctaattgatctgccgcagcaatctctgtcgcgtcatgagtaatcatgatcgttgtcacgtgatcctgctcatttaactgtcgtaaccaggcgtgcacgatttgcttattattttcatccaaaccagctgtcacttcatctaataacaacacttttggcaagaataagatgttgcgaatcagcgcgacccgctgccgttcaccaccggaaagctcggtaatcggctgatgcagggttcgttcggacagcccaacattatttaacgccgttaccactcgttgcgtatccatgacttgcttacgaatttggtacgggaaagctaagttatctgccaccgtctcaccaaataacgtcggttgttggaaacaatatgagacttgccgccgatacatgattgggtcatagctttcaatcggctgcccatcaaaaatcaaggtcccactcgttttagaaatcatggccgcaatgatccgtaataacgtacttttcccaccaccggatggtcccgtcaatgtaatatgagccccagctggaatctgccaatcaacatcatgtaaaatatgttgatcagcgatttgataattaactttttctaaactaatcaatgaattcatatgcccacccccgattactaatttagaatcattataacctgactgttaggcgactttcaaacaatcctcctcagttatcctgtgtctttccacatgctataatggaggttaacacagttcacagaaaaacgaggtcaaaatcaaacttatgccacaatctaatcattattcgcaccaatcccgatcgcacaatgatcggcaccgacaacagccggatgaaaaagtgcaagcgaccgttaacatcggccagcgttttccactgaccattcggcgtttaggcattaacggtgaaggtattggctattacaaacacgtcatcaccttcgtcaagggcgcccttcctgaagaagtcgttgtcgctgaagtaaccgccgtgcacccacgttacctagaagctaagattcgtagtattcgcaagcctagtcctgaccgggtcgatccccgcgatgcctatgcgggcgaagtcggtggttttgaattagaacacctcgactacccggcccaattagcctttaagcaagatttaattcgccaagcactcgaaaaataccgcccagctggttatcgacactatgatgttcggcccactattgggatgactaatccttatgaataccgcaataaagctcaatttcaagttcgtttaatcgatgaccacgtcgctgctggcttatataaagaaaatagtcatgacctagtcgacttaccgacctgttcagtgcaaatgccggcgacaatgacagtcatgcgtcaagtcgtggcttggctggaggaactccaagtcccgatttacgatgaagaccataattctggcatcgtcaagacgatcgttgtgcgcgaagcggccgccactggggaagtccaacttgtcttcattacgaacacaccgaaactgccgaaaaagcatcaattattgatgaaaatcgctgaaaagttcccaatggtcgtgtcagtgatgcaaaatgtcaatgctggcaaaacatcattgatctggggtgaccaaacgacgttactggccggcaaaccaactattacggaggaactagacggcctagtctttgatttatccgctcgggccttcttccaattgaacccacagcaaaccaagaaactctatcgcttagcacgcgaagctttgaacttagcgcctaacgagacgttggtcgacgcttattcgggtgtcggaacgattggtttatcactagccgacgtggctaaggaagttcggggaatggataccattccagcagccgttgcagatgccaatgccaacgcccaacgcaatcaaatcactaatgctcattatgaagttggtgaggcggaagtcttgttaccgcaatggttagcgagcggttttgcgcccgatgcaatggtcgttgatccaccccgtactggtttagataacgtcttaattgatgccatcttgcaaagcgcaccggaaaaactcgtctacatttcatgtaacccatcgacgcttgctcaggatttacaagcacttacccgcggatatcaagtcgactatattcaatcgatcgacatgttcccgcaaacagctcgttgcgaagccgtcgtccgcttcacgaagcgtcattaatttgccactcactgccaatcatattagggggaatcatcatggcagctaccgatagtcaaattgcattaacgatgacctttacgttacggccaccattcaagactcatttcttactattaaaagattacgtggcggatgttcgtataccggctcgtgatgggatgctaacgacgattattgccaaaaacattccactatcaccggccctggagcaactaaaaacgatttttgatgacgtccaaaaccctgtttactggcgcctacacgatcaggccgttcaggagttcttcaatgcgcatcctgagcagcgaccggtcctaccactcgatttgctccaagtcatgctcaatacgttatctgcccaaggtctgtccgatcaacaattaatgcacatcatgaaggatgtctttgagcggctacaaaccaatgacttcaacggacaggcagcacagcgaattttgacgtcgttgaacaataagtaacacgccaccatttatcgctgacttttataaattaggattagataacatcaagttgtctaatcctattttttcggacataaatcaatagcggtaactagctaagagcattcttcagcacatcggtgaaacttcattagtcacagaagcttgcactaatactcgtttttctttttcttagccattcattctattccagcataagaagatggtcttttggttatcggaagcaaacttgttgactttgaagttacatgtgataagctgataactgtaatttttattgctacagcaatttgaaaggatgttttaattatgaaatatgccgtcactgccgctactggtaaatttggtcaaagcgctgttagtacgctgaatgccaaagttggtgcagaaaatgttttagtaattgctcgtaatcaggacaaagctgctcagctgtttcctgataatccgattcgtatcgggaattacgatgatgtcgactcaatgacgaaagccttcgagaacgttgaacgcgtgctcttcgtttcatcacaacctggtggtcccgttgaccgggccaccgctcataaaaacgtcgtgactgcccttaacgccgctcatgttaaatttgtcgcctacactagttttcccaacgcacaggcagcagtcagcgccttagccaatgatcatcgggccaccgaaaatgccataaaagcgactaatattgcgcacagttttcttcgtaacaactggtatttagaaaacgaaatgggcttcttacaaagtggtgcccataaccaagaaaccttgtactgggctaataatacagctggctgggccttggaacgtgaatatgccgaagcggccgcaactgttttgatggcagatgcccctcaagaagtgtacgaatttgctgggacacccctcacttatgccgcactcggtcaagcactccaagaagcaactggcaaccaatttaagattacccaagtcagtcaggatgcgtacgtgcaatcccttgaaacgactggtctagatcatgatacagctgctttgtttgcttcatttcaaggcccaatcaatgatggtgcactggctgaaaagtcggccgacttagctcatgtcttgggacgtcaaccattggcagcaagtgcggccattaaagaagtcttagcgcgctaataacgagctagctgtaagtttctcttaaatatcttctacaatacgaaaataggaagttcaacgaacatggcgttgggcttcctattttttaatgattcgtaaatggccttttaattagcgcgtaacatcagcaaaatactgagctaaggttagctgaataccattatgattattatcagttgttactatgttcgctgcctctttaacgggttgtggcgcattagccatcgcaacaccaatccccgctgtctggagcatcgcaacatcattaaagttatcgccaaacgcaatcgtttcagcaggggtaacttgatcatcctgtaataatttcattaatgcggctgctttagttacgcctgccgcaacgatttctaaataagtttctttcgaacgataaactgctaagccgctaaattcatcacggcttaatcgttgttcaatcgtctgaataatatctggatcggccatgatcatcattttatgcactggcgtcggcatccgttgcaaccatgtgcccaaatccgtgacatggggtgcataaccaattcccgtcgcttcctgctgttcccacgggccattagtagccaccaaccagttattattcgaataaatactaattgaggcagctggccaatcatgagctactaccgtttgcacagcttgtgctagtttagggtcaacggcttgctcttcaaaaacagttagtcgatcattcacatcagtcgtagccgttagcgcgccattataggcaatcatggtcgaattaattcctagttgttgcgcaattccaaacatccccttaggcgaacgtgctgaggctaacaccatttgtgccccccgtgcaaccgctgcttgaactcccgtaattgtagccggtaataactgtccctgactgtcgactagggtaccgtcgatatcacttacgattaatttgatcattgattttcctgctttcacaaaatgactgtttatcacaaaaaggtctggggatccccagacctgcatatcaattactcttgtttatccttcaattcaaacttaactttatcccccacgagtttgacaaatagttcctggtcaggctgaggatcaaatggtcccaggtcgacaaggatctgaccattatccgccacttcatatccttggtaacgatcggcaagcagatgatagattgtttgggctggtcgcatccgctcatccacctgagcggccgccgccttcaaggtataaccagtctgcaataaattactcatcgcggctgccttgataaccattttcagtgtatacacgcgagcccggcccggctcatcctcgttcttaggaataatgtacccctttttttgccaataccttagttgtcgtggcgagacaccagtcattctgcttagttcactaatgccaatagttaattgccctttatgaaaaagctcacgtaaatctgcacgcgtcccgttagtcatactggcgactcctttccaaagttgctattggtataaattatagcatggaatttcgtcgcaaccattaactcgcttggaattttccgtgattaattaacttttctgataatttgttcgtaagtaatccagcaaggactgggcgggacgatccataatcagctgataatcatcactgactgtagctaatagtccgcgggcgccaccggcatacatcgaggccaacattggcccctcaccattctgattgtacatatcgctgaaggcttgcaaggacactggtcgatacccgattgattgcccactcacttgactaagcacagtggcgagttccggcatcgtgtaagctcgggactgtgttaacgtatagattcgaccacgttgtaataaatcaggcgttgtggcgactttagcaaaagcggccgcactatccgcctgactgatgaagctgagggcctgatcagccatgggataaacgacgttgtgccgttcaattaattctggcaaatatggcactaacggatccgcgtaaagcgcattccggacaatcgtatagttaatatcacttccagctaatcgccggggcacgtaaccataaaatgctgataatgcaaatggattattcacctgatcggcaatgaaacccatgactaggaaatgatgcacattcgcccgttggactgctgctaagacgttctcaaattctcgaacccgcgaataactgtcatgactcttactaggaatataaatcaggacatcactgtcttggaaaaacgcgcgtaactgctctggctgctggtaatcaatggccgcaacatgcaagccctgttgttggtatacctgggccttactgagtgtatggacccctaaatataattcagtggtggcgactaacggtctcatcgcggcaacaatctgttgtcctaaatgaccagtggcacctgtaatcgcatatttcaatttaactcgccctttcatgtaactttattagttacatttaactaaatatcgatatatttgtcaaataaagcggccgcttatgatattaacgtcacccattgccgccattaattcggaaacatttcgtcgctacatcgttaaaattaaatacacagaaagggctgccctcattacaagcgtagccctgagaaatgcttttctaaaaatagttaagccctaatttgcaacctgttgaccaaggtgcttcttttcaggcgccttcttaacgtttttgacatcattatcggaaaagccaaacatccacgttaacgtaaaggcgacaatcaagtcgatagcagaggcaatcaagaaaccgtagaaactaaaatcaagccccttaggattgatgaaggaggtcacaccgatcaatgatccggcgaagccccacatgttaacgttaaacagtccggtcaagaaaccgccgacagcaccaccgatacttgcggtaataaatgcccggccatatttcagattgatcccgtacattgcaggttcagtaaccccacagaaggctgagatcgttgctggccaagcgagttctttaatattagcaaacttagacttcagcgcaattgctaagaccgcgccaccttgggcaaccatcgttgcggaaacaatggcattcaagtaactgtgtccagttgtcgtaatatcgttgacaacaattggaataatcgcccagtgtaacccgaagataacgagcacttggtagaagccaccgataattaagccagagatggcgggactgagtttgtaaatcgccacaattcctgcggccaatgcgccagacaaagctgtaatgattggcccgaggatgataacgatggcgccagaaataatcacaacttcaaacaacgggacgaagatcatccgtaagactgtcgggatgacccgcttgagccatggttccaacttacttgctaaccacgcccccgcaatcatcgggaaaatcgagtaggtataggaggcaacgtgaaccggaatgccaaagaagttcgcattgattgccatgcccaataagtgacccgtaacctttccggttgttgccatactaacaattgctgggtatgttaagaccccaccaataattcccatgataaccggatcagcccctaacttcttggctgcggtgaaaccaacaaatatcggtaagaagtagaagacggaatcacccatcgcattaataatcacgtaggtcggcgttgtcgcagagacgaggttgaagttctttagtaacgacaaaatcccctttaagatcccagaagctgccaacaacccgatcactggaatcatggatcccgtaataacaccaattaagctgctaaaaccgtgtttgaccttctgccacggcgtcattttctgccacgctaaccggttcgcttccttctccatcgcaacagccgaagcgtcagcatccccaaagcctgcgcctagttgacccacgattgcatcatacacgtcggtcaccgctggcccaatcaccacctggtactgaccacctgcctttgcaatatcgataacgccctttagatttcggattgcctcgtcatcggcctgcccttcgtcctttaagtaaaatcgaacccgggtaatgcagtgaatcacgcttttcacatttaccggtccaccaacttgagcaatgatttgagtcgccaattcatcgtacttgccgcccttacccttaaccaccggtgcttcggcaacgtgttctttcaattcaacaacagcaccgacgaccccggcacggacttcacccagttcgggcgttagtttagtaaccatatccgccgtattcgttacggccatgattaccgtggtatccttgttcgcactagtaatcgccgctaaatccatcacggccactttttcgccggcctcgaccgtatcaccaacttgcacgttaactttaaacggtggccgatctgctagttcgaccgtatcgataccaagatgaaccaacacttccagaccattgttccccgtaaagccaatcgcgtgcagactcgctgcaaccatcgttactttaccactgattggtgcaacgacctggccgtctgtcggttcaatgccgaatccttgccccatcatcccttgtgaaaacaccggatcgtgaaccgactcgagtgatactaactgtcctgcaactggcgttaataaatgcacttgcttcatagcgattctccccctttgactaatcaataatcgcgttgttaacaaactaatttcggacactggttgttataaaatcactaataattgccaatccatccagtgaccaactgtcaggccctcctaactaatcaagtaacgcccttaacaataaaagcgctttcctttataaacataataatagccgcccctattaagtcggtcaataaaacccgattaaattaaggcggttcacttgaatttaagaacttatttaattagtttgccaaactttgtgaagcaagtgttaatcgttgcgttgcaagaaaggaccgttcgaaatcagccgtcgttttgacctgtttaccgaaatcaacaatcagtgcgtgcaactcccaagccgtcgttaaatcataatgccacgcctgcataatcagttgttgggcctttaagtagttgctcggtaacggttggttaagccagccgaataggcgccgcaaatacgtgtcaataatgatcgttggctgatgaaaaacgtacatgctaaagtagtcagccgtttcatcgccaataccgcgcagagcgattagttcacgccgcaattgttctgctggcaaggctcgcatcacggtcaagtcaaaatcatactgtccacaccacgctgctaaagcttttaaagttggaactttgcgcgtatagaagcccgcgggtttgactaaagtcgtcagttcagtatcagtcaatgctagtaaccgccgaggctcaaagtcagtggctgcttttaaattagccagtgcgtaatccacgttgcgccagttggtattctgaacgagaataccgccccagagaatctcccaaggcgtctcggcaggtggtattccggcttggagccagtgccggggccccatggcagctaacatctgctgatacagtgtctcaatggtcattgttagccctcctcacatgaattggttaatgttgagaccaataatttgatcttacaaaaaaatagtcgtaacggcaaaacaccaatccgctacaactattgtttacgcttgtttattagtcatctgccaccgtactgcgcttaacagctagcacaatgtcagccttccgattttcaggcttgatcttttcttcaaagtccaattcggcatccttaaacaggttctgaatctcagtattaactaacgacaagtcgcgtgaatccccggcttgttggcgaatatagaccacatattgatctggtaattcttcaagatcatattccacatcttcgtcattcaaaataacataaatcaacttacgttctttgttcatctgaaacttccccttatcaattattttatccgaattagtcgtttgcggctaactggtgagcaaacttaaggtagtcagccacacaatggtctaaccactcaacgaccttattgtccgtaaggtccccatcggcattcatcttgtcctgcaccgcgctcaacaagaattcatttccaggcagaatctgcatcccaactccgggtgaatctaaaacttgccgtaaatgactctgcgctcgcactgtccccaagggtcccattgtggcccccaaaatcatagctggtttcccaattaacggtcgttcaacacgcgatagccaatcaatcgcattttccaagacacctggaacactatggttatattccggtgtcacaaaaatgacgccatccgcgtccatgaccgtctgcttaaaggcttgcacctccgcgggggcttctagctcgatatcctgatcataaaaaggcaacgcgcccaagctaggaatcgtgacatccagttgatcggcataccgtttctgaacaaacgttgctaacttacgattatatgaggaacgtcgaatgctaccgacgagtgcgataatcttcatcgtgtgaaaaactcctttaagttgtaattacttttagtataccccttttttggtaaatagtcggaaccggttacaagaaaccagccgcttttctcaaaattttacaattcacagttgaatgtccagtcacactcagtcggtttgccaggcacaagcccgtgcaaccactatcgccgaaattctaattctgcttgctagaccattaaattaacaagattgctaattttctcttgccgacagtaacaactgccaggcataataattaggataggctactatttccatcataagattaataaacattcacaaatgtttattaacttttttcaaaaccaaacgtccattgttagcgtgttgaatagagtctgctatactaatgattagagaaattgattggggggttaatcgtgtattatcgtggtgaagcacttgactttttgaatatgctacatactgccggcaccgcgccattaatgcgttcacggatcgttttttccagtcagatcgacgtggagcgcttaaaggctgccgtactcgcttccgcacaaatcgtacccgagattttcggtcattatcaagctgaccgtaatcgtttcgttgttactgatcaaccagtcaaccaagttattcaggaagttcaaagcccgtatagtcctgaaaacactgattttgattttacgaatagtccgcaactacggttatttgtcattcatcacggcgactacgatgtcttacaagcctttatgagccacctactaacggacaatcgtgggtttaaagaatatctatacttactggcgcaagcatacaattatggtgatctaacaaatttgcataatgaacgtcgcttacgcccagttatcacgaaactgcaacaccaattcgcccggccacacgcgcacgcacccattgtcactgggatggtcaagcttccccactatccgggaatcaatttgcggcacggtggccacgtgatgctcagtagcacgcaattcatgcgcgtccgacgagtggccaaggcccaagacgtcggtattagcgaggccattttggcggcctacgctaaggcactccaagttttaactggtcatacaaccgtgacattaccgtgcccaatcgacctacgccgcttcacgactgaggattccaacgtcacccaagtcgccaatttgaccgtcaatgtttttctgacaatcaaggtagatatcgatgcaccctttagcgaactcgtcagtcaagtccacgacttgttaacggttgaacgcacccgggtcgcattcctctatcggctcagcaacttacagaagatgaaccatacgatgccgatcgcggtcatgcgcaaaatgaccaagcgctggttaccacaacctgcattacgatataccaactttggtgttgtcgaccaggaacgccttaaattccacgacttgacggtcgtcaactgtgtcttttccggtgcctttcagtgctcaccgattatggaaattgctgccagtacgtttgccggcacctgtacattgagcttcaatagtaccgggtccgaacgtgactatcaattatccatgaagatactggagaacattcaggcccaactgttagtgtgggcacaagccgatactcaagttgccacaactgatagtgtgacgttgcgccaccaagcataattaagttaatttatcggtctcaaataccggcccaaaaaatcccaagcatatttagcttgggatttttttgtggctagcgccattagtctgattattgtggcccttgatggcttcacatcattacgataataatgcctagtcagtcaaccgcaacactttcaagtaatgacttaactgatatatcggtgctcgacgcgccaacactggcggtacctgacgaacttccactgtacaccctgctggcccacttatggctgattgaaaatcataattctgaaagctcggtcggatgggcacagtcaccgccagcggctcagtaacgcgctgtaagctgatctgaatactagttaggtctctggaaagggctccccgctaaattacttaaaaagccatcatacaggcgccatagcgccccggctgaaggcacccagactggttgttcagtaccggcttgtagcttgaatcgtagcgtggcacactgtcgagtcacggtcacttgactcggtcgaacttttaattgagcgctcgctgcttttaaagccgtcacttgggccattgcttggggaacatcgtaactcgccgcaaatacgggaaactgattggtgggcgcctgccgcccatccgacctagtcacgagttgctggataatcgctaccatggcttcaagtccaagcacgtacgcacgttcatattggactcgttcaactggtaatgctggtacaattaattgcgtcattttaccacctctatccacattcacttaattatcgttagtttactcacgtcctcagccccagtaaagccttttcagccatttcgttaattaattttgtcaaaagttttatctggtaatgtttctaaattggaatccttctaaaaagtgtggtttaataagggtgaatatgataaaaggaggtaccgcgtcgtggcagaagatatgttaacccaagccttgcagcaattaaaggaccataagatccgtgtaacgccgcaacggcaaattatccttaattatttgattactcaccataaccatccatccgttgaaaccatttatcaggaactggcaactcaattacctaacctgagcttggcaacggtctacaacacgttgaagctttttgtcgacctcggcatcgtgattgaattacaaaacggcgatgctggcactcactatgactttttcggtcgtccgcattatcacgtcgtttgtgagaattgtggtaagatcactgacgttttcgaacccgaccttcgcagcgtcgaagccaaggcggcggaactctctgggtacttggttacgggtcacaatatggaagtctatggattatgcccagactgtcagaaactactcaatgtaactaaaacagctgatttaaagcgcttgaaattgacgcacagtgaatagcaccagttcaatggcaaccggctatttagcgcgctggttatcctaaaacaaaaggaacactttcagttttcctgtattagtccctgtcaaccttaagtggacgatcacagcctgaagtgttccttttaatttatacgatatgctgattttactgacgctttaatcagcatcacaatcggaggacgcttacggaatgccaatcagcaattacacgaccggtagccctcaaccccctggccggtattaatgttgtgggacttcttccagcatgccatagaactgtgacttgtcagagaaatctgccatataggccccgttcaatccagccttttgcccgattgttcctaaatcgatcattagcttttcttcttcatccggaaagtgtaaccgtcccttaatggctacgctccgaatatagtttactaggcgattgactaaggcttctgggttcttaaccgtagtgatttttttatcgacctgcattaatacatcaataatatccaataagtcccccgactgatcagaccacccgcttaatcggacgattagtcccttaatagccgcttgagcttgttgccgtaattctgattctcgccgcattaataaagtccccctctatatgattcggattaccataataatttcaaattataggtatctttatatacactttttattatacacgcttatgattgcattcaaaaaaaacattcataaacgttcaaaaaacgcccatcaacgtaaaaaaagtccgagctttcacccgaacttaaccccactttaatttactaattaccctaacgttcctgtccaaacgcaaaatagagccatggtccaaatggttgtacaaaggccaataacaaccagcaaagtcgatgtcctcggcgaaatgacttcgccgtcaagacatccgcaaccacaattgtggttgcggtaatctccatggcggcaacgggtaacaaccgttgctttaatttacgtttgattcgtggtggcatttgcttgtgatgacaaaatagtcccatattgacgcctcccttaattattaccaacattataccttgttaattaagaaagcgctatcttggctcatacccttgtggggctcggccgacaaacttagtgtctgggatcgtcaattcatcaataaccgctttcccatgcagtaactggcgcgttgtcacaccgacctgtcctcgatcgattgtaatgatttggtaactactaccctcatgaacataatgatggtgtggatcatggcaatcgatcgcataggccgcagaaccggccaccacattcagaatattatccccgttcagataactggaaacaaagtgaacgtggccagagaatacgccaccgatattatggccccggagtaccgacaacagcgctggcgtattttgtaaaatcgcatagtgcatattcgtcatcgtcggcccatcgagggggtgatgtaaaaatagaaacgcccgctttgtcggtgcctgtcgtagatgttttcccaaccattgtagctgttgtggtaccaaccagccggcctcataaccgctaacctttgaatccaagaaataaaagtcgttgttgccaatccgcatgcgactcgcgtagtatggtcccgggtcagccggcaaatacccttcgtaaaacgccgcacgccgatcatggtttccaaggataactcgaacatgacaatcaaattcagcttccatcgtatggacgattgcgtgcagccgctgataatcgtcagcgctaccgtcatgaatcaagtccccggtaaaaacaatcaaatctggcatggttggtaatcgccgaatatcatcaataatattggcaagtttgccccagggatcgtactgctgaccatgtgccggtacttggccgcggggggttaaatgtagatcagaaatctgaataacttgtaaaggacgcaattcgattctccctctcatactttaatcaccagatggttacctctaatatagcgagctaacgtaaagttttaccaatcttcatataaagtaactgtaaagtttgtgctaacctctctttacgcaccgttaaaaagtgcccccgcagcaacatcttcccccgatagttcaaccattatccgtatcgccctcattatactgagaccacattatcggcagcgcgtgcccaatgattttactgtgagtcttcagtatatccgcatcctattccgccgtcccccagagctagttgttcttgacctcagcgcttggcgcatgccacccgtgtttcatactgggttagctagtctaacgcgtaatctcataatttctggttgacaagcccaccttttgccgccaccatgaagataagctttaataacatcacacgaatgagggattattttgaaaaatatgtttgtcgggccccatgtggcccttgctgttccccagccagaagattttgatgagatcagtgactggtacactgacgctgattttgttcgtaaaatggatacggcggctgcccgaccactgaccggtgaagaactcgaacgaacttaccgtaaccttgatcggaataccgaatactactttcacgttcatagtttagaagacgaccacttattaggatttgtcaccctattcaatatcgaatggcataaccaggttgcccaattagccatcgcaatcggtgatccagacgaacggggccatggttatggtaccgagacactcagcttgattttgaactacgcttttaacgaattgaatctttacaaagtctgtttggacgtcatcgcaacaaaccccgccgctatcgccgtttaccagaatagtggctttgaatttgaaggtaccaataagcgtgctatcaagcgtgacggacaacgaatcgacctctatcacatgggtttatttgcggctgatttccaaccacgggttactttaaactaattaatcagctcaattagttgcagccaataacttttgcaattataatagtcgcagattgatagaaagtgaccaactgactgtcaatccttaatattctttagttttttcgattattagcgcgttgctgccataatgcagctaataatcactttcattcatagactcccccaagtctgatgaatggggttcatcaaagcccccactttgatgtttcctactccttgaccactacatccgctgatgtggtggcttttttattgccgtatgaaaaaaaaggttgcaacaacaatgtttgtcaccgctgctacattaggggctagtgtattaggagcgcgtgcagatacggtaaacatgaaccaaaataacggggaagccacaagtacgcaggctgcagtatcatctactccaacaacggttgatggggcgactaccgcagcaaatcaagctaaacagaaccaaactgtagctaagcaagccgcatccgatgcaaaaaaggcacaggatgccacacaggctgatgaaaatcaggctagcaagcaacaatcagctgcgcagaccgttgttactgacagtcagtctgcagttaatgatgcacaatcggttaaggatcaggcaacgcctgaaaatattgcagcggcacaatcagcggctagtaatgctgcaagtgaggttgttgttgcaaatagtgctgtagattcagctatggcatctgaagctactagcaagaccgaagtaagtcaagcacagacacaagttaatagcgcagcaaacaatgttgcggctgctcagcaagctgaagataatgcccagcaagcagctaatagtgctgcacaaacggtgtctgatgaaacaactaaattgaatgatttaacgccggataagatcaatgctgctaaagaagctacaagcaaggatattagcaccaatcaaaccgatattgcaacaacgacaaatgatttgaatgatgctaagacacaagtttctagcgcgactactgcagtggataagcaaacgactgtagctaagcagactgctaatgaattaagccaggcacaaacgaaccaagctgcagcgcagactgcaaacacaacggcgcagactgctaaaacaacggctcagaatgaagttaactcattacaagcaaaagccgacacccagcctaagtttaatatcgacgttgcggcatggaaaaaggtcgttaatgatcaagcaacaatgtcgtccgctgattatcaaactgaatacaatgcatttatgaataaggtatgggctgacaacggttatacaccaactagtactgataccaatgtcaaactttcagattactcatccttaacacaagatcaacgtgatcaattgatgaactttgctctggatgtaatcaaccaggccgttcagatgtggaatggcgaccaatcacataactttaagagtactcgtgaagacatgaatatttcacaaggcttggcagatgattattcggctgcaaataataatatttatgatggtggcgatcatttagtcgctaagattcaggatattgaaaacaagtatcggtttgacacattgggtgaaaactggggcggtacgttcctagataacgccaagagctcaggtttgttatcaatgggcaccatgaaacaagctatctatcaggatgttttaggaatgatgttcatggatgctgatagttcatgggggcatatgaagaattgggccgtaaatacgcctaatggctatgttggtcttggatttgataagtatgggaatactcattatgtgatgcacacgccgtttagaactgatgatacaacgtcgaatacgacacctattaagcattatgaacaaagttcggacgtaaacgctgcgttagcgaatgcgaagacagtactagcacaaaagagtactgcagctactactacgttgaatgctttgaatgcggcaattgcaactactgcagctgctaagactactaataacaacgcacaagcaacgttaaaaacagctcaaacatctttgaatgaaaagaatgcccgtgtacaaacgctaacggctaacttatcaaatctacaatcagcattgaaagcaagccaaactaaacttgctaatctgaatgcaagtttagctaatctagcggaggcacgcgctgctcaggaaaatgttattgcacaagctaagagcgatgcagcgaaagctaatcaattgttaactgatgctaaatcagcaacgaataatgcacaattagcgcttgataaagcgaagcagaatctaacaaataaacaaaataagttagctgcagccaagcaagcgatcttagatgcacaaaaagtagttgctcaaaagcaagcagcattgaagcaggctgaatctaaagtatctaaattagaaaatgcggatgcaacattagcagctgccaagagtgcgctggcaaaagcggaagctgtgcttgctgacaaaacagcggcctacaacgatgcagttgctgctaataatgttgctaaggctaaattagcatcagcaaatgctgacaaacaaagtgcggatcgcacttacacgcaagcaagccaattattagcaactttaaaagctaaacaagccctagaggaacaattggcaaaagaacaggttgctaaggatgaaatggataaagctacagccaaaaaggataaggctaacgctgttgaagccatgaaagattatgctgatgaactacaacagtcggccaatcttgcccaaaagcaagcattgttatcaggtaatgcgagtgatcaaaagcttgcagatcagttaatggtggaagccaagaaggctaatgaacgttaccaggcagcattgtcggctttaaccgatgaacaaacaacgccggccacggatcatattaatggagcacggacatccgtaaatgttgcaatgttggatagtaagactggtgtagttatgccatcattatcaagtcatacacgcaaaatgaatgctgaaacgactagtgataaggttgccttaccacaaactagcgaaactcatggggcaaaatccggagtatttgctgggattttatcattagtatctacgattatgttattcggaatgaatcgtcgtaagcgcactaactagttgcgtgtgtggtgtcactaggtaattttatgtaatttgatgagtataaaaggagcatgagggtgctaataggttggcaccctcatgctcctttgttaataaaagataatcagtatacgctgtattcacatggttataaatcaattaaaatacaccatgtcttaaaatgttagtttttaatcttaaactattattgaataatacctttacttatgggtgcttcccaagtgagttacactgcattaaactgtatttgtaagtataatgcagttaactacggacttatgaaaataacaaaggggctaaaatggataataaagaagaaaaattattgctcggcggatttagcgaccaaattttttctgcaattcaaagaaatattccgttagaaagacggcaatcccttttgattaaactgggtattgacacggttttaaacgttcttcctaaattgattgtgactattattattgctgtactgttgcatgaattgataccggttgtaatttttgttgttagcttcctattgctacgaggatttgcctatggccgtcatttgcaatcggatctggtttgtacaatattaactattattgtttttacaggagtaccatattttatccattttactggtggaatgcctgtttttggtaggattttatccagtattatgatgattataggtattggaatactggcacctgctgatacaaggaagaatccaataacttcacgttttcggaaaaaacagttaaagaaaagagcaattttagtgtcagtgtttcttagttcactccagcttgttatcagtaattttacaggaacggtggttgcagtagcaatgtttactgcgctattgctactgattccactgagaggggggaagagtaatgaaagaacaattatataagtgtttagcacgtatgtttgaggttgttgggacgaagcaattagtaatgtcttgcagtggagtattatttgaaataaagattccagatgaattaaagagcgaggattagtgaatcaaatgtttatggttgtagtccaagagatattcttttacttaattataaagtccttgcttcgtgagccattttatataagattatttgatggtgcgtttctattagttatattgtctagcacttacacgttctctaaatcattgaatgtttatcttttatcaatgctagtattgtttgtctttatctttttttcgtggtggtatgtacgtaatttagcacaggcaatgagtattacgttgcaagtatttatttggtccgtgataatggatcatttaagcaatttgggaattcaaatagctcacattcctaatgggtatattgcaatttttgtgacattacagagtataagtgtaattaccttaaatgtgattttagagcgaactaggtttgaaccaacttttgagcgtaatagtttaaatagaattatcgcgtttttattgttgataatatatgcatatattatattcagtgaaggctgggacaatcaatttagaatgatctttagtaacttagttattttgctagtcttggttagcctaattttgatgttatatactgaatatctaaaaaatgtgaagactaagtatgcgattcgacaaaaaagtactcaaattaagaatgacacgcgatatatgagcgaaattgaaactcattataatgagctaaggagattccgccacgattaccaaaatatgatgttgtcaatcaacgaatatttgaagactcacgacttggatggtttacaacagtattactctaagaatattgagccagtgactaaaagagtgtccgatgagcagtataaccttggggatttaagccagattaaggtcaaatcagtaaagagtatcttatttagtaaattaagccatgcacagtcagaaggaattaaagtgcattttgacttaaaggaacaactcgagaagatttctgtaaacgagttagatcttgatattgctttagggattattcttgataatgcaactgaggcagttatcggtcataaaaatgcagaaattatgagtgcaatatttattgagaaaaatagtgcggtatttcttgttcagaataccgtatttgaagaattaccgccgctatggaagttaaagactgaagggtattcaacaaagggtaaaaaccgggggttaggattgagtaatttaagcaagattgtaaatcgaaatgataatatgatattagaaacgcgggtacttggttctgtatttttacaacgtttgactattaagagtgagtccgaagatgattaatgtctatatatgtgaggatgatccaaagcaattgcagcaactgcaacaaattattaatgcggtaattgtggatcaccagttagatatgggtattggtttagcaagtcaagatccgcatgagttatttgatcagataaaaattcatcaaccggagaaggcaatatatgttttagatattgcattacattctgatctgaatggtattcagttggctgataggatacgaaatttagggggacatagcaagatagtttttattacaactcatacagagctggcactgactgtttttcagtatcaagtagaagctctcgactttatcctcaaggattttccagagcatttgtatgatcggttcaataaggtgcttcatgttgctgagaatcgttttaagtcagaggagtatttcaaagatagctatgtgaaaattaaggttggggaaactattcgatctattgatgcaaagagtattctgttttttgaaagttctgtaaatccacataagattgtagtgcatttaaatgatggggaattcgagtactacggtctattgaaggatgctccagagatgaatcataacttctatcggtgtcataagtcgtacgttgttaacttgacgcaaatcataaagttagataaccatttacggcagttgacaatgtcaaatggtgaacaaatattatgttccgcccaagcttgtcgttatctttcaagattgaacagtggaaattaatctcacaagaggggtattggattaatcgtctaatacctttttttgtcgtgaaatcaattaaatccatcttaatcgttcataagataactttgctagtcttaaagtggtcgttacgactattttatttgaattataattgaattgtttcaaaaaagaataccaacatttcaaataggggggatttattgtgtatctttcaaaaaaagctctaacaagttcattagtattgactagcttattaggcgtatcaatgttaacagcgccggtgaaggctagcgctatgactactcaagcaagcacacaaatcaccgcttttgagcaacaaactggtgtgctgcggactgatggtatagcaggaaacttgtctgcggtctattcagactccgatggtgctactattgttcgctggctaccaggtggtcaagattatagatatgaccaagtggttcataacggctttactggtttgacttactaccgtattgctactaatgaatggattgactcaagcaatgtacaattaattaattaaaaaacatattaagattacttgagtaggagggggatttatcgtgtatcttacaaagaaagctttaacaagttcactcgcactgactagtttattaggtatttcaatgttagctactccagtaaaagccagtactatgagcactcaagccaagacacaaatcactgcgcttgcaactgagaagcaatccggtgttctcagaactaatggtatttcagcaaatctagtgggtgtcttctcagatccttccgttgagcataatgtagcttggatagaaggtggacaaaattatcgttatgatcaagttgtccataatggatttgatggacgaacttactaccgtattggtgttgaccaatggattgcctcagataccgttacactaattagttaatttaatgtaacaataatatagataaaagttttcaaaattagtcccgtagaatcgttatatagattcgcggggcttttaagtaaatacgacgatggcggcttttgattgtaatcgatgttagtggcattatcctgaaaggttttaaatcagtcttgaaccaataattgtgctcttatgaagtcttaaaatgtacgttaggactgatgataacaagatataataagactgattaaaaaagaagttaatgctttaaatatacagggggaatcattacatgaaaaggcttttaatttcagctttggtgttatcgggcgttgcaggcgtattttcgtttggtacaaccaaagctgatgctagtaacactactggtacaacaacatcaagtatgagtgctgtatcagctaacaattctatttatgacaatggggtacaagtcaagtctgggatagttcaaactcataattattacggaactgtatatgcattagttgatagcaacggtaatgtgagtcgctatgtaggcagtaatcttaagtataaatatgatcaaattgggttcatgaatggtgaaacgtattaccgggtctccactaatgaatggattgctgcttcgaacgttacggtattaagctagtcagaatattattaatttggaggaaaaatgatgaaaaaaacagttgttttattaatggcggcaggtctactgggtactacagtagcaggaacgctatcagcaaatgccagtgaaaacactcaagtagctagtgctaccaacaaggttagcaaggttagcaatgtcagtacgtttgaatacgacaaccctattattattaaatctggggtagtccgcactcacaattattacggaactgtatatgcgttggtcgacgtaaataacaattttaaagttagtcgttatgttggtggaaatgaaagttacaagtatgaccaagtatacgatactggccgttatggaacctattatcgagtttccactaacgaatggattgccgcttccaacgttgacgttctaagttgattgggggaataaatatgaaaatcagtcaaatcattgctaaaacaagtattttaatttttactatttctggaacagttattggtagtgcaggagttgccgcttctgcttctacaacaactaatgcgcccagtgaatatgttcaaaaggatagtaaggtgggaccgggatattatggcaataataccaacactcgcgcttcacggtctgctcgcatggcgcaatcctattcagctcagtcttcaactgctagtttcttagcggccatcaagcctggagcaattaatacttggaaaaaataccaagtgttaccatcgattactgcagcacaggctattttagagagtggttggggtacttctggtctaacagtacaagcaaataacttatttgggattaaaggtagctacaatggccagtctgtaacaatgtccactaaagaagaagatgctaatggtaatccatactacgtgaatgcgcaatttagaaagtatctggactgggcaacctcagttgaagatcatggaaactttttccatgacaattcaagatatcacaatattttggggctgaaagattataagcaagaagctaatctgattcagcaagatggttatgctacggctgttaactatgcgtcttcgttgattggcttaattcaacagtatggcctagatcaatgggatcaagaagcatttaatcaaacgactttcccaatgaagccaattgatatgagtgttgctacagttaaatttgtaagtggttatgggattaatgcttatgatgatagtggtaactatattgatggtagtcgtgacattttcaaagatggcactgcttggaaagttggcgagcaacggatgatcaacggccaagaaatgcttcaagtagcgactaatgaatggattcctcgtcaatatactactttagatgcgagtgttattacggtcaacgctattcctcaaggtggagttaatacgtatgatttaaacggcaattttactggtactgtcttgacctctggaactcagtggaagagtgatcagtttgcgacgattaatggtcaacggatgtatcgagtagccactaatatgtatattccagaacgctggactcaatttggacctggtaagtaaagaaagaattaaacaaaggggaaataaacgtgaaaaagaaatggttagcattattattagcattaacgactgttttaggcttagtctttctcgggacgacattgaatgctagtgcgaattcaatagttcgggtaacttcagacagtgccaccatttataatggggttgatggtactgcaactcgcactttacctattaacagtgcctggcaatatgatcaacgagtgcaaggtaatggtggtgcttggtggtatcgtgtcagcactaacgaatgggtaaaggatacaaatgtttctgagagtactcaaagtgccaaaaacgctacaggtgttgttactgtcaaaagtggaaagactgcaacagtccgagcctctttaaatggccgtcctactggtcagacattatcaagcggaaccgcttggaagtattcacaaactgcggttgacgcatggggggttacttggtatcacgttagcagtgatggttgggttgaaaatatcgatgtttctgaaggacaaggacagagccaaggacgtaacggtgttttaagtgctgcacgtcaatatatcggtgtaccttatgtatggggcggcaaaactcctgctgggtttgattgctctggctttgttgcatatgtattcaagcaagctggctacggtagcaaattaccgactgcatatacaggaaacttgtataatgatgcgattaataattttggtgcatataaggtttcccaaagccaagcacagcccggtgatttagtgttctttggcaactatccttatgaccatgttggtattatcactggtaacggcaccatgattgatgcacagaatcgtggcgttgttgataatgacttgcttagatattttaaggggacagtaactattcttcacctgaattattagtttacagctacaaatagaagtaagcgccataaacattgttaaaaatgactatgcgaagtattgttcttcaaattatcgtttgaatagcggatagaagagagtatcggtcatacccgatactctctttttataaagattaatgttacagccttttcaatatatagatgatgtactgaaacagtttaagcaaaaaaacttggattcatgaattaactacatgggagcgcacatttatgcgagtgttaagtacgatttttgaagagatattagtagtgattagagatattacaaccgttgctaatactcgaagacatgaaaagaatataaatgatagatatatagctaaaatgcaacaaaaaagttcatacaaacaagcgaaaattgatgagaaaacaattatgagtaatcgagaacttgttattaaaccgagtcaggatattttggcgtgtgtaaattcattttatgaagctactgaacaattagtgattaatttcccaggaacagcatatacaggtagacatccggaacttttatataagaaggggatcattaatgactgggtgggttttccagagtccattcaagaattgaaaaaattagatgctgaatggtggaagcaatcaaacttgttcgaaaatattattacagtaaatagaatattgatttctcaaaaaatttacgagtcactaggagaatttttggcagattgcgaaacaattaaagattacttttatggccgttttaataatattgatatatgacgactagaaagggaaaaggaagaatataacaagacaaaggctgatctgaataaagtgattaagcagactccagaaatccgtattgcaaacaaagtgttggaatattatacggatctaactagtctacgaaaacgaatcataaatgagatgaatatgttggtgaactaactagctagatattttaggatatcattgacatgtctaacaatgaataataactttaattaagaaacggcgcattgtcccttttcttaacataacagttagaactatctttattagacatggaaattttcagcaaattgtaatttgtatttgcaaaaacaaaagctaaaaacctgaatctgctgtgtattagtcatttatgtttacaagaatacgtcagcgacaagccatttcatcttcttaaatttaaactgcttctatatcgtctaattaagaaattttgtttatgtgtgctttaaggattaccatttgtgagtatttcaataatccctttatagcggttaggaacagtagggtttctgttaaattcgctataaatattgattcgttgtttttgatacgttagtaaagcaaaagggaataaagtttcaccttgttatggtaattagatcaacatcactgataactttagcgtttgggaagatacttttgtttcacttcaattgtaaattcgtcatacaaaaagtgatattgatagattttatacatcaataccaaatatcataggcccaaaataaaccagcaaataccaatgtccctgattattcaggacatcggtatttgctggtttttaaattagatgaataacaaaattagttaatcaacatattgcgcgtagtcgatccctagtcgcttggcgattccggtaacttctgcgagtgtcttgtcatcaatctcgatgccgttagctgaccggtcttgatacgcggcagcttccttatcgccggcaacgatgactggtttgccgggaacggatggtaggtcgcgaatggcttgcaagtaagctgaaaacttagcaataatggcatccttatcaccaaagattgaagggtcgatggcgacaaagctctgacaagggcccacggaaaggtcgtccggagtaatttcgttggaggtgttgcccattgaaaggattgctgtgaaaacctcgacgatgacgccgagaccgaaccctttgtggctaccggtgtcttcggtaacgccacctaatggagctaaaccaacattggaatctaaatcacggagggcatccaagtctttggtatcgttatggctattaacgggcgtttcgccatccttagcgacccataatgcgggcatatctttacctaatttacgataaacttcaattttaccttgtggcaccgtcgttgtggccgcgtcgaagataaatgtgttcgggttggctggcatggcaaaggcaattgggttggtgccgaccaatgctttggtagcatgagtgggtaacatcgctgaacgtgaattacacgacgacaggccaatcagaccttcttcggcagccatgttggcatagtaacctgcaataccatagtgaccggagttacgagtcgtaacgataccgataccgtgttgttttgctttttcaatggctaggcgcatgctatagataccgttcaattgacccaagccaaagtgcgcgtcaacgaccgcactaacatcggtttctttaacaacttctggctgattatgtacgcgaatcttgccgttacgaatgaagtcgtcatacatgatcattcgctggacgccatgggattcaatgccaatcaagtcggtgtagatcaacatgtgggcgacttcttggctttctttttcggtaaagccgtaacctttgtaaatattgtaaatcagttgttcaatttttttgctattgtatcgttttaccattacattcaccacgttatttgaaatagacttaagtgacagccctgtatattataatatgataataataagaactttgaatgtcaattaaattttaataattcgttaatcttacgctaattaaaagtgtcatcatataacaggtcaacctgagtcttcaaagcgcatgaaattgaggtcagactaactcaaagctaatgccgggtcatatggcacggaccaatcataaattaggtataactaaaggggtcatcaataaagtgtgccgttaactgatggcctgtttagggtggccctcattagtagctggtgatgaattggacgaaataaattgcggctgcggcgttggctgatgctagcgctgagaccgcgaaattgcggtttaggtattgctggtcaatgtgcagactagaatggtaagttaaattatttgcgaatggttgcagttgttgcacacgtgcttgtggataagttaaaggaattagatgacaaatcggtaattagttgggactaatgactgtaaatgttaataacatgacttatttgtgggtaagtgcatgagtatctggggataagtaaggaaaatgaggataattgtggtgaatccagccatccacagtgcataacttttatgatgtagaagttatcaacagatttattagatatgatgtgaaattgattactgggttaagtggaaaaatgagtgtcgtaacataatgtgaaatggtttggcatattaagctgtcccgaaagcaatgctttaaggaaaattacttgaattttcaacaggtcgctgacaaagcgtatcgttctttgctattatatttgcttattgctagatcggcaaccttggcgtagtagccgtataaaactgaaaacctctgacaaaagaacgactcataagcgctaatttatctcatatctatctcaaaagatagtacctattaataaaaatggtacttacattatgccttagtatcagctatagtagcagatactttaaagctaatgaatggagcgatagtaatatgaaaaaaattattgttaatgaatatggttcagttgatgttctgcaagaagttgtcgcaccgaagccggttccaggagaaaaagatgtgttgattaaagttgccgcgataggggtcaatgatccagatatcgtgatgcgcaagttcggcccgtttccaacgatgccagcggagtttcggccgacgttgccacacatgctaggtggcgatttttctggaattgttgagcaagttggtgctgaagtcaccaagtttcaggtcggtgatcatgtgatgggctatgctaaacaggggacgtatgcgcaatacctcgtgcttgatcaagatgattcgctatcgaaagtccctgaccagctagacttgatgtcactcgggggactttacctaactgcattaacagcttggagtgccatgataaagaatggtcacttgcaagccgggcaaaaagtgttaattcatggtggcgctggtggtgttggtagtatggcaatccagattgctaaggccatgggcgcaactgtaattacgacggctcgttcgcagcataacgcttatctaaaagacctaggtgcggatcaaatcattgattatcaaactgaagattttacagaattagttcacgacgttgatcttgtggtgaatttgacgggcgcacaaaccttagccgctagttatcaagtggtgaaacggggtggccgcttggtttcggttaacggggtgccagataagaaacaagcagccgcacttggaattacggcagtctatgcacttggcgatctttcagaggatgctcgcaaggctattcttgacttgtatcagcaaggtcaattaacggtcactgtttcgaaggcctacccatttacgctcgccgcggtcaaacaggcccatcttgattttgaacagggtggtaatcaaggcaaacgggtgattgtctttgaccaggaaatgaccaatatttagctgattttatcgtcagtggacgcgcctacccgagcagttatccagatacgacactagaagtgggcaatgacacgaatcagcgtgcagccgcgcactaatctgttctaaactagtattagtaaagaaataaaatagctatctagacaaatacggtatcatgaacgacggtggtcggacaatctttagtataatagtgattattagttaacgtcgtacgattggttaatcatgaacagtaggtggtaaatattatgaataaatcggtatcggatgaaaactttttggattgtccatttgccagtgttcaaaaagtcgttcgtggaaaatggagcatggttattctgtatttccttagccagcgggtcttgcgctttggtgaactcaatcgtaagatgcccatggtgacccaagcctatttaactaaggaattgcggttacttgaagaatacggtttagtcaatcgcaaggtttatccacaggtgccaccaaaggttgaatattcactcaccccattaggagagaagttcttgcctgttttgaaggctttggagaactttgcggtagactatcaggattaccaagcttaattaagtgaaatcggttaagaacgagcatgctccggtttattcacggcactaattgtcgtcataaaaattaaaaaacgagatccagcgacgtcttcatacgtgcttggatctcgtttttaggtagaactaagtgactatcgagcccagagttgggtcgaatggcgatgtcacttgcccttgaaccgcataactaaaatgataatattgcttttaaattctgaaagctaatgaacaactcttctttgaaacttttattgggaatattgttttatttaatacgcatgatttatctatccaagaaggtgtctgcattatgcggcagaatttggcgcgagtgttgacgttgttttaactgacaagattagtttttggaaaaacttagccgaacggattaccatatttttgacagtattggtaaaatcctaagcggtatagatcgatagttcgggttagttcttcactagattgaaaatgaattagttgtaaaacggcggcagtaaatgccagtgccgctgtgccgttagctgtgactagattcttgtcgctaatgacttgctgttcatgaaagtcggctgagttttgatagttaggataattgtgccacatcgccagtgaattgccggtatgctgataaccagttaaaaaaccgttttgggctaagtaatctaccgcaccacagattgcgccaactggttttgaggcattgaggtgttgctgaactagtgaatataataatgaattattgatattccaagagttaccaccaattaggattaataagtcaatagttggtaaacgatccagttgatagtcaactttagtggtgaagccaccaattgacgtaaccaatggtgttgttgaagtcgttttaacttgccagtcagtgctttgatttaattgactagctagataagaagcttcccaatctgcgtattgatctagcattagaaataatgcagttttcatgttgacctccagaggaaaatatattttcagaaccgaatatgttatccttaatcataggaacgtacgttctaaaaagcaagtgcatggttaaatgttggagggcagtaaatgagcaaacaatccgtaattcttgagttaattagaacacatatttgctatacaccacgggtctttcaacgtattaataagaaattagccgttaatttaagcgaagttgaaattaaagatttagtcaatcatattctgatacaaccagatgaaatcaaaaggtgtgggaaaaattattatatccgaagtcgtaaagcgcgggtagaactaacagtcaatgctggtaattatcgcttaattacagccagtaaatacacagaagtcgacggcttttaatcaataaaacagctaaaagtaataaaaatattagtgaatccgtgtggtggttgagtattttggcaatggaaaatgggttttacttggatgatgcagtgaagtgcttcttacgaaataaagcgaaatacttaaaaagttaattaatgttagttgagaataattacaggagtgtagcacactttaaaagcaataaatccccccatcaggctagtatgaaaatctagctgatgggggaatttattgtgtgtatatatttggacgtgatttaattacgagccgtcaccgatttgacggattaaacagcttataaaccagtattaattgataactagtttaaattaagcgttgtgtcaaatgtcttataagcgttatcgtcgtcataatcgtcagtatcataactagcatcccattttaggcgaatactagtgatgtctttaacgctggataattttgataaaataaagtatacgttaccgtcagaatcggtaccactgtttaaatcaccgtcaaaatcatcgctatccatgtcggcttcgacttgttgaccgtcgttcgtgctgagtttggcctgggtcggataggctgaaatatcttgcccggcatggatactcatgtgaacttttacgacgccgttaaaatctttcttgtcattaccgctaccgctagtataagtgccgtccgttttgtagaccgtgactttatcgattttaaatgtggatttcgcccagctactgtcggtaaatgaggtactgtaagctttttgatcggcgatatcgatgtcgtcatcgccaatagtgatactgtcagaatctgaatctgaatctgattctgattctgaatctgagtcagagtccgtgctatcactagattcttcactgtcgctatcgctgtaactgtcgtcagagttagttgcagctgacttggaagttgtcgttagagcagcgtccatggcagtatcacgggccgttatgttaatgagagcggcgtatcccaatgtcaataagactagcaggcaccaagtccaccatttgtgtgtccaaggttttggttggctagctaaacggtcgaaacgttttccagctggttcagagcgttggcataggaaaacaatgattaaaatggggccgacaagtggaagcagatagaaccataaataatgcgctgatcgattagagtcgtgaagtcgccgcgcactggctgtgaattgcatcactgaagtccaaaccatgagcgctgaaaaaatcaataacagcacggtttgtaaagcattaacgtgtaatgggctgaggataaacgctggataactgtatgctctgataccaagtacgatggttaaaactagggaaatcaggaccaaatctaagtaaagccaccaatattgaggccgcgtaatccgttgtgaccaagtaaaggtttgacgcattcctagctttagtgcggtccacatattgacatgttctggttgattaggtgtgttgtgctgctcggaagtaatggtgttctgatcttcagtggaagcgactttgtcctgagttgcgccacaaaaagggcaaaaggtcgcgttagtaggaatcgcttttccacagttaatacaatactttgtttctgacatcgatgttcctcctggagtacttatactaggcgaaatgttatgaatataagtataattttattatatggccgagtgaatgattatggcagccgaaaacaagcatatcataactagttaaaaatattaacaaaatattaatactaaattcatattttgttcaataatagacttaaatagttatttatttgctttgttgaaagtggcaattataagcttaagtaaaaagccgtgagctagaattgatcctcggattttgaaatactagatattggtcatggaaggaagaaaccatttacggcaattgtcattatacaaattaattaggtgcagtagtttgtcgacatagtaatcgatgattagttatagactgaacacgataaaaccccagcgagcttttaacttgctggggtttaacaattaattgattctattcagtgctgcttggggaatgtcttttcgatcaactttttcccagttaatcacttgttggcgtttgtcattataaccgactttgagataagcgtgcatcttgagtgagcgtggtaggacgctatcaaaagtgagctctttcttaacaccattgtcgctgtatccaggttgtgagtaatggtagtagacatagggcttgccggaatcatctttcccggttttacgttcacctttagtcgtgatttgagtatagtatgtttttgttccgtaatttgagtggtaccagttgaaaccgagaccaactggtactaatacgataatagtgatgattagtcccaaaattcccgcttttttcattaataatccctccaaatgattaattgaaatctgatattaatcataagagatataagaaacggtggatagcagtttatgcaatgctaaacgaaaaacaagtaattaaatataatattaataatttaatgggattcaaagtctgattcttgcatttcatgataagttgtcatcttctgatgaagaaaatccaagttagcttgtgttgctaccattaggtcattaagttgtgtttcttgtttttgcagtaatatcaaacgttcagggattgtttgattaccgatatagcgcaattgcgcgtagcgttgcatgtttcgaatcgacatgcccgtttgttttaaacgcttcaaaaaattaacccagtcgatatctttagcctggtattgacgatgattaccggcagttcgcgtgggacgaagcaggccgacttcttcataatagcgtaacgtatcgattgttaggtcagtttgtcgtgaaaattcaccaatttgcattaatttgaaaacctcctgaaataaagcttgatgtcgggtacacccgaggttgtaacctagaatcaatcaaatgaaggagctgattaaaatggaaaataagcaacggttaattaatggaaaagccatgttacaacgggtggatgctgaagcagctgatcatgtaatggctagtttggatagggtggcaccggatgtggctaagctaattcttgaatttgcatttaatgatatttatacacgtcctggtttatcgttgcaacaacgcgaacttgttactattactagtttattaacgcaaggtgatacagcagaccagttacgtgttcatctcaacggatgcctcaacgttgggcttagtcgtactgaaattgtggaaacttgcattcattgtattccttacgttggttttccgaaggtattgaatacgttgacggtggttaaagaggtttttgcgaatggtaaaaattaggatagacattattgaaaaaggtttttcctgatcatcaatactatataacaagttataaatgattcgtgattgacaatttataacttgttttttgttagaagaatttcaattataagaatatttattaatggtgtaactagtttgcatggacactctatggagatttgtaacctagattgttagtatagaagtaaatgtgtattgaatggggaatctaaataatgagaaagaaaaaatatattagtcagcgtacacgtgcaactcatacttattctttttatcgtcagcgtcggaatgatcctaattggcgggctgattacctggcggctcgggtatgccgacaacgtcatattttgatcagtcttattattatcttagtcttaatattaattggggttattggatatagaaatcgagtagtgacattgttgaatgggtcagaaacaacatctcaagtaactacagtgaaaaatgctagtggggaagactcaattaaagattctaccaaacaatcggtttctaacgagcaaactaaaacaatagataatgtgcaaaaaacagtaacgattagtgattatcaaagatattcagcttattctggcgaatatggaagtgaaacacaaacctgttcacttgattttgcaacgggtgagctaatgaccactggaccacaaaaacaacaagttttttattttgataaagtcatgttgcatcctgataaaagtctagtcatcaacatgcatggcaattatcattataatgcttatgatggtaagggtgaacggtatagattggttcacctgagtgtcttatttgcaccccgtgatcagaaaattacacaaaattggcagactggaaagtcacttgaggatggtactaatacggctgtcaatcgattctcgattgcgttgtcaaatgatggcggtaaagtgtttcaaatgtcaccagcgtatacagcatttgagactaatcaaactaaaggtgatacattagcagtaatttattccgaagctaattgagaagagctattttagacttaatataactatcgtaattatcttcaatacatctcaatatggattaatttcatgtgaagtagcagttgtagttagtaatactttcaatgtttcaaactaagtatttaagctaagttagcttgttttaaagtgccgttagttccagaactaaattggtttccagtataatacgctagtagatattatttaacggttatttaatattggtacttcaatctgaatagggcagtttatgctaaatcgatataggaaaaatcattatggtaatgcaagggggaataatgatgaagacagatatcattttacgggttgtgcttggcttgctgtttactggcttaggctgttttcaaatttttgctgtgaggcggtattttcgccagttaaaactgcacggaaacgctgaaacatccgtttttgcaccgctggctttgtggagcgcctttgtaattggcttgatttttattttcgttggcatagctgcgggctttgggttgatttaactaatatttgttgggactagtaaaaacaccataaacaaagtgcactgcggataatcgtagtgcactttgtttatggtgttttgaattaaaaatatgatttgatggttacgataatattattttattcatcaatttccggcgccgacccaagctctgcctgaatcatccagattttcttttcaattgcagttttgagaccaatgaaaatatcttgggtactgaagtctttttcaacatcggatacttcaatgccgtgttggtaaaggtcttccaagtaacgatagccatcaactaagtgtgcgaggcgttctggggttgttttgtcccattcaccaggccagtcttgaatcttagtgttttcggccatttcttttaaggtcgagtaaggactgccatcaagcgcaatcagccgttcagaaatgacatcgagttggctgtcaatttcttccatgaactcatccatcaaggggtgcaacttcaaaaagttgggtccacgcatgtaccaatgcgtctgatggataatcattgacatctggctcaaatcggcaacgagttgatttaatactgctttggttttcgtatatttcattagattgatctcctttcgatatggctattataacttagtggtagcttaatctgaaacgttatacactggcaaattaagttatttatagcccgtagaattaagtcgttttgaaaagatgggggcgttatatggtggtaattagtgctaacaaaaacggccaccgtatgggtagccgtttgggtatcttaatcagtgtcgaattagacctattcccgtttcttgaacttagctgccagtcctagccaacctaatccagtaaataaagcggccaggataccaccaagtgttgcggagtgttcagattgctcactggtttgcggcaattgacctgaattttgcgtagcagccgttgctggtgcttgctgttttcctggttgagccagagcactgactggtgcgatcggtgttggctgtggactagtcgttggcgccgattgtgaagtcgtagtgctttgtggcacgggtgcttttgccagcaatgaactccctggctgtggtgccgggtttggctgcggcaccgggctcggttgtggtgccgggtttggttgtggtgccgggctcggttgaggtgtaggactcggttgcggcgttggttcaggctgaggtgctggtgtcggctgtggttcgggcacaggtgctggccccggacccggcgtcggttgttcaggctcactcgattccggcgtgtaagtgtaaacgacgtgctgagcggtggtgccaaatgtcccgctggttggaccgacaactttgtcgaagacgtagcctggaattgacaattgttcggtttgatagttttgaccaaagtcgccacttaaaacaatatccgcgcgaagtggttttccatccgcatcttgataactaacggtaacgggcagtactgcttgtttttcatagacgtaaaggacatgctgcggttccttggtaaagctgccggtcgcgttagttggtgtcttgatgagttgatatcctggaatcttcagcgctttagtctcatacgctgcgccgatttcaccagtgtgggtgatatcaggctgtaaggatttgccagcttcgtcctgatagctggcagtgacaggctgtggaatctgcttggtatagatgtaggtgacttgctgtggttccttagtgaaggtaccagtcgcgttgccgatagtcttaactaagtcgtagcctggaatctctagcgctttagtctcatacgctgcgccgatttcaccagtgtgggtgatatcaggttgtaaggatttgccagcttcgtcttgatagctggcggtgacgggctgtggcacttgttttgtatagatgtaaatgacatgctgcggttcagccgtgaacgtgccggctgcgttgtcaggtgtttttgtgagatcgtagcccgcgatttcgagtggcttggtcgtgtatggatcacctgccaaaccgttgcaagtcgtgtctggctgcaaggtctttccttgttcatcctgatagctgaccgtcacaggggccccagctgttttatcataaacgtaagtgaccgcttgcggttccgcactgaaagtaccttgtggggcgccttgggtttcgacgtgggtatagttcgtaatatcagccggggtgctttgataatcttcaccaacgaggccggtcaattcttccgagtcgcgcagagcggcaccgttacgatcgacatggtgaatggttactggggccgctttggctgctaatacatagggctgaaagacatggaacaccggtgaactgccatctgagccttgagcaaccaaataaaagtttttatcatttgggacaacgttgatgctgacgccgttagtgacgaactgaccgttggcatcaccagtgaagcctggaatctgtggtactaactgattgaatgtcaacccaccttgaccgtcgggtaccacgttactcaggtcaccattcacggcttttcccgcgccgttgaagtagaaacggtagtagaattggccgttaggagttagttgaactggtttcaaaatggcggcttgcgatttaaggacagcttgctgcccgtttggtaaataaaagcggttctttaaggttgcgctggtcgtgtcttgatcgacataaacgagcggttctagaattgtctgcccaagataagtagttgtcttgaggttcggtaagtctttaaagactgacaaatcagcaatatggttgtaagcgacgtccagttcttgtaggtttgtcaaatgcgcaatcggcgataaatcactgacacggttatgctgaatattcagcacagttaatttggtcagaccggccaatggtgaaatgtcagtcacgtcgccgttataataaccgccaagtgcgttgagaccgttattgagccaaatggttttcaggttcgtcgcgtattgcagtccttccaaggagtatggtgtgtgaccatcaatataagtgttttctccatagaattgggttaataattgcatatcatctttagtaatatcgttaacagatttaaactgatggtcggggagcttcaacgcttgtaactcgcgtaaaacggctttttgaaggtgcttgttcggcatccaagtatcaatagattcagttggcgtcgtcgctgcggtcggcacgattgtaccaacactagtcgcgggcttttcagctgtcgttgccgctgaagcagcttctgcgctagcttgctcggcatattcggaataggtactggaagctaagctattaatagcactggtaatttgaaaagtagttgctgtcgaagtcgcggtgctagcgggaatggttgcatgcgaagtgtcaggtgtcgcggcgctttcggcactagcagcactagcgtcggcggaatacgtgctggcagcgatactattgacggcgctggttatcacgctagccgaggcggcgcttgcctcactagcggccgttttagcaccactagtgggcgcagacgaactgctcgaaatggcactcgtcattggatgaataacctccgagccgtcagatgtctggcttgtacttgtagtgcttgctgcggctgatttttctgagctagtctcactggaagtcgaaagcggcattgactcggcagcactatcagttgtcatcacactagtaggagccgtgctgttggctgccgtactattagtgacacttggtgcagcggcactagccgtcttggcggttgtcatgctgccgactgaagttggtacgggcatacttgcagagctagcaggggtcgttgaatgaattacattagaactgtcagtttgctggcttgtactcatagccttgttgggtgtactactttcagcactagttggactggaactagcattaggcgttgcagttgtgtctgttggatacttagtggtcgcagagctggccatggccgccgaagttgggatcaggttattggtgcttgctgcctcggtcacacttgaactaggttcggcggcgtgaccacttgtcgctgaagagctggccattgctgacatcaatgagccactagtagccgttgatttcacgggcattgctgcggtactagttgctacaggactactggttgtagtactgccagttgcgctactaccagttgtcgatgttaaggtaacttgactgccggatagcgggttagtcggcgctgtttgctggacagtaggcgcagtggtggtgggtgctgttgtcgaatcagtggccgcaaaggcgtcttgattggtcaaaataatgctggccaaaatcgtggccgcaatcccagtaattaagtgccactttggtgggttattagtgataatttttcgcttgttcaaaataatcatactccttttgatgattgatttagtcataagcacactaaattagttaaagtgtagcaccattattttggtgggtctagctagtttggtgagcgtcttggcacttagttgtgaatggctgaatgacggcactttccaaaattatggaacaaaccgttgtttgacggtacttaacgctgatatggagctgagttagaacggatggacattaagaagtgcacgctggtagcgctgaaatgcttgttttttaaagtttggtggctcgcaaaggcaagttggtaaacttgcctaagaatggcgctcaagccagagctaccgattaactcgtgaggttgcggtgagtagcgtacttattagtagtcacgaaactgtcatcagcgtattcaccgtgaagacagcgtaaaacgaccttcccggatagtttctgggaaggtcgttataggtttataaataaggggctaatgactaccgattgattgctggtgtgtgtattgcgccgcgtgccgaccggaattgcgtccagagtagaaggcgtagccaacacaggttccaggcatgttgggaccatacgtgtcgccggtcaatccagaggcgtcgttgccagcagcgtatagaccggtgatcggttgaccagcagtgtccaaaacttcattattagtggttactttgagaccacccatggtacaaaaggcaccaacattgagttcaaagccgtaaaatggaccttgcgaaactttaacgagatattcaggattcttgccgaaatcatcgtcttgaccattatcacaatattggttgtaagtttgaatggagtgggtgacttgatcaacaggtaggtgcattttggtcgccagcgcttcaatcgtatcggctttaaaaataaatggtttattggcggccacggctgcatcgatttcagcctggagtttcgtcattttttcgccccgccgaacgtaaacacctaagcccataaagttcccgtcctgagccattttgtcgatcacaccttggtcgagaatgctaaatacttggttttgggtgtagagcgcgttgccggcgtatgagaagttataaacgacagcttcatcgacaaatcgttccccatgttcgtttagccagagcaacggttgctgaccggccgctgtttccatctgagaagccatgtacttaaaggaaggttcgctcggatctttgagataaccgccaaagagcatcgccattcccgtgccatattgttgggcaccgacctgccacgctagccgaagaccgtcaccagttcctttacctgaactaactggaattaagcggtgcgtgtcatagtgggtcagtttctgcatcatgtcggggttattgaggtaaccaccggtagcaagaatgactgcggccgtattgatgacttgggtctcattagtggcggcactttgaatcgttacaccggtaattgcaccgtcagtggcttgatgtagcgtggtggcggtcgtggaagtcagtagttcgacacccagcttttgtgcttgtggttgtaaagcgtcatgtaagacggctcggcccattcctttataaatatgccacgtggcttcgccggcacccattgcttgtacgccttcgtattcgacaccttgatctttaagccattgcaccgtgttggcgctatcgtccaagtaacgacgccagattcgagaatcagcgcgatatttagaatagtcgacttcttcttttaaaacgtcagtggcggaaacgttgatgttttgggccttttgtaagtatgagtcgacggcaaagagaccctcagtgtaattgctgctaccgccagtatggcgtcctttttcgagtaataacacggacgcgccgtgttgtgcgccttctagggctgccgctgttcctgctgctccggtaccaacgacgacaatatcgtatgaatcatgttttgctaacgtcatgtcaattcctccaaactgatttgttatctaatgagcatttgacggctaaattcaccattactataatgaagtaaccgctatcacaccctcatcataacggggggatggtggttagcaaacagacaatttggttcggcaggcgaatcaatcgtgcggatggagttgaaaaaatggatcttgaccggttacagacgttcttaaaagttgttcagtatggtagttttcagcaagtggctgcccgtgaatatcgttcacagcgggcggtatcaaagcaaatgacccagttagaaaatgaattgaaagtgacgttatttgaccgtggacagaacaggattcgcttgactcctcagggccggctattttgggcatctgcgcaggatattgtgaataactatacgacggccttgacggagctacgtcaatttaatgttcctactgatcaaatcttacgagtcggttatttctcagcctttgagcagcagctcctattaccagccttatacgacttaaagcagcattcggagctacaactcgttgttcggcaagggagtaacgagcatctggcgcagcaagtcactgatggttcacttgatttagcactatcgattaattatggccgtcccgccgttacaccagaatcacagttaacagctgtcccgatttatcataatcaaatggtgattggggtgagccggttaaattcactgagtcggttgtcacaattgccaccgagtgcgttggcgactttgcccattttatattacagcccagaaagctcgacatttttattagaaagttttttggctagtgccccatttatccaaaactatgagcagattcggcgagtgccgagtgcagaacagatgcacttgttggttgcgttgaatcaagctttggcgttctatcctgcggggctagtgccaactgagcatgatgaacaagtcgcgtatttgccgattgcggatgatgcgcaacaaggctatgacatcgtggcgttattaaaattaaaccggtctcggccgttgatagccaaattggtacagcagttaaaggcgaacgcgaagtctgacgagtagaggattaacctcaccgcgagatagttccgatgcggtgagtaaacggaccggctgagattgcaagcctgtaaaaatttagtgactccgttataataaaaccattgttctcaaatcaatgaatttatacaggaaagtgggcccaacatgtttcaagatattcaaccacacgttttaaaaaatcagaatgatcagcagcgggcaccccgggcgggcgattacgtcttaattggtcgtcaacaacaggtgcttttaatggatggaaccttgcccaagtacgaagatgtcgatgcggattacgcgtttagtgctgaccagtatcagtacttgctggctgtcgatcaggcggcctttttctgggtcgacgttgatgcggttgcgaatgatagctataccgttggcacgacgcgggggttccgcgacctaacaccggcctggttggctttcagtagtgcgacggctgcccacttggcttggtggtatgacacgaaacggttctgcgggcattgcggccaaccactacatccgggcgctacggaacggtcactggtgtgcgcggcgtgtggtcagaccatttatccgacgattatgcctgcgattattgttggcgtgacgaatggtgatcaaattttgatgaccaagttcttgtccggctacaatcatttttcactgatttcaggttataccgaaatcggtgagacctttgaagataccgttcgccgggaagtctttgaagaagtcggccttgaagttcataatattcgctactttggtagccaaccgtgggcgccatcgcactccttactggccggctattttgcggaccttaataagaacgtggcaattgagctcgagacggacgaactatcgaaagcccaatggttccagcgtgaccaaattcctcataatgatacgaacacgagcctgacatggacgatgattgaagcatttcggcatcatcaggaaaagtaaattagcgtaatcaaagtagatttttttcaattggtatccgattagtgcttattcgccaaggttgttaaaatgagggataggcttaaatgagggtgagatgtgaaatagcgtcaccccctttttgagagactggggcttccttggggtcaactgttgtacttaactgttaagtcgccagcaataagcgatttcaacgctggtattgtgacatggtgcgagttgaaccatgtcgtttagattacgagtaatgactaatttaacaggtgcggtggattagtaatcagattgggtatgacttttaaattgaatcgttatttcaaagtagctgccgtcctagtaacggcagtttttttaaaatacttagttaatgccgaccaagttttacttgccaaaaagaacgtatgttcgtataatggcatataaaaggactggtgatgagtatggaacgagtcgtcccccgtgagaagtggttatatgatgatcgcggcatgatgaagtggatgggctggattctggcgggccatagcgcctacattgaaagtgaacagcaacagcatcgtcaagccccggtgcaaccagaaatgccggcggataagattgatcaggttttgcaaatgagctggcaaacgcatgcgacagtgctcgttcagctggatgttttggaccatcatcaatacgtggcagaatttagtggccaagtgctgggatttaatgctaatcagatttatttgcaactaccgtccgcgcaattaaagtcggtgtaccgtgaagatattcgcgcagttcgactggccacgactgaaaagtggtgggatcatgacgacacccttggatgattctagtcgattaccggttcgagatatcatgtgtattgactgtaagagcttttttgcgagcaccgaagccattcggcggggcgagtatccgttagcagccaaaatcgcggtactgtcgcgagaggaatcgcaaggcggtttagtcttggcggcgtcgccggatactaagcgcgattacgatgtcaagctcggcactcgcaagtatgagatcaagccacaaatggatattgaattggcggcacctcatatggcggattatgtgcgtttgaattatcggatcagtcagattattcaacagtttacggatgaagcgcatacgtttatttacagcatcgacgagttgtttgcggacgtcacgcacagccataagttgtttggaacgaaccgcgatatcgcgtatcagattcaagaaaaaatctttcaaacaactggaatcgtgaccacggttggcatgggacccaacccattgatggctaagttagcgctggacaatgccgccaaggtctcagcaccctggttcgcttactggcgttacgaggatattcccgaaacaatctggcagattccaaaattgacagatttctggtcgattgggcataaaacggcggtcaaacttgaacggatgggaattcactcagtatatgagttagcgcatgccaatcgtcagcagttaaaacgccagtttggggtgctaggtgatgccttgtactttcacagttggggtatcgattattcggatttgacgaaacgatatgtcccacgcgcagacaatcgtggttatggtaatagccaggttctgatgcgtgattacgtcacgcgagaggatatcgaaacggtcttgttcgaaatcgctgatcaagtcgcgacacggttgcgaaagcacgctgttctgggggaggtaattggaatttctgtcggctttgctaccccggatgaacgtgggcggcatggctggagtgcgcagacaaaggtggaccccaccaacgcgacgaatgatttgattcgcgcggtccaatatttatttgaaacgcggtggcagggcaacgccttgcgtaacttaggtgttcgtgttaatcgaatcagtaagcccaacacctttcaactatcgttatttgaagatgatgtccggcatacggctaatctccggctagagcacgccattgatcaaattcgggctcgctatggttaccggtcgattattcgggggtatagtaaaaagtctgctgggacggccgtagaacggtctacactattgggcggacatcaggcgtgagcaccgcccaatcattagtgaggtgagtagtatgttggcagaatcaaagcaattattggccaactttgaccgttattttttgcgacggtatcagtggcggtaccacttgttgatcgtagataatcattttttggattgttttacgttttttctacaagcccagcgccttcacgagcaattaattcacagttatgacttgcttgaaataccgcatcaacaagaactttaccagcaagtgttaacggacctgaaacagcacacggccttgcaaatcgaatttcgcgacactcaccacttggttcatccagggactgatattgtgcatgatgtcaaccatggtcattaagatggtggataaaatactgattcgccagcgagtgtcataataaaaaccagccacaatgtaagttaattggctggtcgcattagatttatcgagaattagttggagaattgttcaattgtggtagctaaggaactgacttgacccgtgttaggggcgtaaataccacgcgacttattgaaagccagcggtcaacggtggctgccaggttttggcggctgattttaacttgattaaaggcttaaaatcgcattgaaaacactttgtggtagcttaatcgtatttttggacgcgcgacgtttattagcgctttgccgccgtagtagggccgcttttttggaagtgctgtgttgttcgccgttcaccgcagcgtttttacgcaatggtgggacatcgacgcgggcgataaccttaccttccacacgtgcttggacgggtgtgggatataattgccgtggaaccgtcgtcttcagattggcgaccaattgctgcgtcatgttgggggcgtcttcacgatggacgatgaaggtcaacgcatctacgggcgcatagttgatatcaacttcaactttgactagatcactgacctcattagccataaaggcggtgcttaaactcgcaaagccatgtgagactgattttagttctgagaaaaagtggtaggcgatttctgacaagggtatcttgagactcgcaacaatcaagtccccgctgtttgccaagtcgatcaaggttcctttatgctgttccgcaagctttaagacggcatttagattgtcagcaggcattgtgatctcggctttcataaagggttcagtcacttctttaatgagactgaatgccggaaactgaacgggattattgacgatcacttgctgaccattggtgagtgtaacgtggtaagtcacattgggagccgttgttagcacgtcgaccccgtactcatcgtggagtcgctcacgaatgatttgaaggtgaaaggtcccaagaaaaccacaacggaagccaacgccaagcgcctcagatcgttcttcaacataggtaaatgacgggtcattcaagttcaatttttgaacgacttccttaagtgccggatagtcattattcttgggatataagcccgcgaagaccattgatttggctggttggtagccagctagcggccgctgcgtgggggtggcgacggacgttagcgtatcaccaacacggacttttcgtggatctttaataccagtgaccacgtaaccgacgtcaccagcgcttagcgattcttgggggtgcatttgaggtgcgaagacaccaatggtcttgccgttaaaatcctgttgtccttgcattaagcgcagtgcttgttgtgatttgagctgaccatcaatcagtcggacataggcaatgacaccttggtatgggtcatacaacgaatcaaagactaaagctttcagtggctggtgtaagttgccttggggagctggcaaccgctgtttgatggcttccaagacggccggcacgccttgcccggttttagcggagatttgcaagacttgctcgggtgtgaaagcggagtcgaggtcgttcaattgggccaacgcagcgtcaatatccgcagagggcagatcaactttattgagaactggtatcaaggttaattgacgttgtttggcaattcggtaattagcaatggtctgcgcttgaacgccctgagtggcgtctactaataggatggcaccctcggtagcagccaagcttttagccacttcgtaattgaaatcaacgtgaccaggggtgtcgattaagttatattcatattcttgaccatcgtcggcctgatagtaattccgaactgtacgtgctttgacagtcacaccatgagcctgttcgacggtcatatcgtctaataattgggcgtgttgttcacgcgcactgacggtctgggtcagcgccatgatttgatccgccaacgttgatttaccatgatcaatgtgggcgatgatggcgaagttacggatatgggattgtttcatttgtgcgaaaactccttcaaatattgggtcaagtagtaacgaatttgttgttgggcctccggtatgagtcgaatttcgaagtcgggataatcaacggataatttatgatgattaaagctggtcaaagccgccatattcatgagcccactgataatgccactttgaataatgaacaggtggctaaattgggactggtctaataagtggtctgtttggataacgagttgttgtcccaagcgttggctggcgcgatacagggcctcacgttgtgtgatggtttcctgcatgttagctttgccttctaggattggcccacgaatggcattcaatcgaatcagaacgcgatgttcttcaattaattggcgagtctgggtggtcatccacgcgataaaatcgtcagctgatagtggtggttgctgggctaagtcggtcgtgagttgggtaaagtattgctgatagtcttccaataagatcgtcatgaacaagtcttctttggtcttgaaatagcgaaaagtcgcccccttagagctaccgacggcttccgcaatttgctgcatagtgatttcgggatagctcctatgggcaaataaattaatggcagccgtcatgatggcttgacgcttggctgctttttgactgggcgtatagatattagccatgtcggatcctcctaatttaaaaatgaccggtggttatttttgaaccagaatacgccaaaaataaccacgggtcaagattgaagtggcgaatgctgggctaagtcggtcttgagttgtgtaaagtaccgctgatagtcttccaataagagcgtcatgaacgagtcttctttggtcgtaaactaacaaaaggtcgttccttttaatatttaattattaaatatatggtattaattatagtttctattggaataagttcggagttaaagggagagcagaactgcattatttagtgggatttattattacaactggcaatgattagataactaggcaggttgggtgattaaaagcgctatgtgtagtttgcggatatttttgaaagtgataatcaggccgaatattaacggtgttcatccggtttattcggtctaactgtcacgtaagccttctggattaacaggggtggctaaatgcaataaatacgttaaaatttttaaccattataaaataataatgttataattatacggtaaacaggggaaacaatactgtctgttatctattgttgataataagggtatcagcgcgatattaaatttatttttataatcaaactgtggatgaaaggttaacggctgagccgttagtctctgataaagggcgataatgactaagaaacggtgcaaaaagacgccagtacgtatcagaagcccaaaatagcctgcgttatattgtaactaccgtgcaggctaatcgttggtaaggccggttaccaacgactagtgagcaagtgtgccaatggttactagttgcattaggtgttctactactgggactgttattgattgctagttagggtaactataaatgtgagtgctatcaatgactgaagttaaaagattacgctgtcacatagaattgctgattaaaaggggatggtcgggtgcggcgaatatgtaaagtattaatggtaattatcagtattattttaggaagtagtgcgccattgaatatggcaataccaccgttattggcgctggccgcgccggacactagtagttcttcgacgatgagtagcagcgcaattagcaaagttactgataccaatgtgatggccgtgagtgcggatgtgacgagtacaacagacacgtctgatacgagtagctctgacagtacgccggcgactagtaccacgacgggtaatgataccactgagacggcagacacggcagtggaatctggaactgttgggacggtagcatggaccattgacgacgcaggggtgttaacgcttagtggtggtagctttactgatttaactggtaaacgttcgccttggtatgattatgcttcatcgattacgaatataaagattacggatgaaattacggtcacaacggcttcgaattatggatacttgtttgctagcctcgctaacgtagcaacagtcacaggtttaaataagctttcgatgagtggtgtaactagtacccagtctatgttttatcgtgatagcaagttaacttcagtcgattttggacagaccgatttttcaacagtgactactatggaatcaatgtttgaagggtgtagcgtgttaactaaagtaaatactacgaactggaatgtcagtcatgtaaagagttttaagagaacattttacatgtgtggaaaactcactatgcttgatgtgagtaactgggatgtaacacaagtaactaatttagacagtacattttctggctgttcttcactgcctgagttagatgtcagtcgctggaatactgctaatgtgacaacactagcgtctacattttatagttgttcttcagtaaagataataaacgcaagtggttgggatacggcacgagtaaccgatatgactgctacttttatgaactgtactttggcaactgaacttaatgttagtggttgggatacagcgaaggtaactagcatgtctcgaatgtttttttattgtgaaaatgtcatccaactagacgtttctggatggatcacttcccaagtaacttcactggggagtatgtttcaaaactgttctaaagtagtaacgctggatgttggtacttgggatactagtaaggttacggatatgtcatttttatttggaggctgcagttctttaacgactttaaatcttgaaaaatgggatactggttctgtaacaactctttattccaccttttataactgttctgggttgactagtttgctggttgatacttgggatactagtaaagttacaaattgtttttggacgtttggcggttgctcatcattaacaactctcaatcttcgtagctgggatcttcaatctgctaccgccagttacgggaatttttttaatggttcaaaaaaattgcagcatttgacactaggccctaattttacttttcataatgataagacgatgtacttgccggagccaagcaaacaactaccatacaatgggacgtggcaaaggaacaatgatgatccaacctatacgtcggcggaactaatgactaattatgatggcgcaaccatggcggggacctataactgggttaagacaagtggaacggtgcttgtcaaatacgtagacggcgatggtgttgaaattgcggatgaagagacgtcatccgggacatcgggtgatgcttaccaaacaacggccaaaacgattgatggttatacgcttcatgcaacgccaactaatgcaactggaacgtatgacgcttcgacgattacagtaacctatgtgtacgatggtaacttattcttcaattcgtcaccaacaatgctcgattttggcagtcatacaatatcgggaacaactgaaacttatgcgcctactctggataagacacttgcggttcagaacaatgggcaaataagttcaacctggaatttgactgcagaactcgatagttcaggctttgtgggagcgaacactggaaaaatgttgttggctacattatattaccagaccgatgatggaaaaatgaccttgtcacctggggtagccgtacaagtctactcacagacaacgactgatcataaaagtgttgatatttcggaacattggtccagcaacttaggattgctactagaagtcccaaatggggctgccatggctgacgcataccaaggaacgatttcatggcgtttgaataataccgtggccaataattaattagtgattcatagttaaaaacacagcttagtttgaaaggaagcgtattgtaatgaagaaattcgttttgggattaatgatttctgcaggacttttgggagccacaacggttgtggctaatgctgatacgactggttcttcgaccggtgatgtaacatttactgggggaacattgtcaatgagtgttgacgctactcatttagctttcggtagcaacacgattagctccagtgatgccaccttagccacttcatcgacaccaaccgttacggtaagtgacttacgtgggaccagtgcaggctggaccttaacggttgctcaggggcaacaattcaatacagctcttaatgggactggttcagcgctgacgaatgctgctttgacagttgcgggtactgagagtgattcggcagtgacaaatggcagtactacgttaacgccggggacaacttcgaccccaggtgcagctgggaccgtcgcttctgctaagaatgggactggtaacggggcatcaacggtgacatttagtgattctaagctggctgttcctgggaaaacgactaaattagctaaggggtacaccaccacgttaacttggaacttaagtgccacaccagaaaactaatctgggtgaatagttagccgatgttggctacggccaatgtcgatacataatctgagaaaagggcggggttaaagtgcagaaacgattgcgattatctttgggaatgttattggcggttgtcgctagtttattaatgatgggacaagtagcctctgctgatcagggcgttggttttgaaatcacgccagtccagtctagcagtcaggttgataagcgtctctcttactttgatctgaagctaaaaccgcgacaaacacaaacaattgcggtcaaaattcataatacggctagtgcgcccattacaatcaatataggtattgctaaggccacgacaaatattaatggggttgtggaatacaaacatacgaataatcgcagtgcgaatttgtcgtatgatattagcaaattagtgacaactgatgaaccacaagtcaagctggctaaggggcaagtcaagacggtcaagtttcaaattaagatgccggccaaaagttatcaaggtattttagcaggtgggataactttcttgaaaaaggccacggcaactgatactaaaaaggccgtggcagtcaataatcaatacgcttatactgaagctgtaattttgcatggtagtaaagacctaacgaccaatcagctgacgatgaataagattacggtcaaacagctcaatgggcgcaatgctattaattttccgttagtcaaccatacggcggcttacttgaataaagtacaaactaacatcaaaatttatcatcggggtggcagtcaagttgtctaccatcaaaagttagcgaacggccagatggcacctaattcaatctataaattgccattgcagacaggagaaaaagcgttagcagctggtaaatacacggccgtcgtgaaagtcacttccaagaagcaacactggcaatttaagcagaattttgtgattacaaagggccaggcggatactttgaataagacggcggtcttgaagcaagggcctaactggtggttgtatattgggattgggctattactgttattattgattatcctggtgatctggtatatctggcgcaaacagaagaagattaaagcgttagagaaacagttagcagagaaagataaataattctgatcaaataaagcaacttctaaaagcttgtactgtttttagaagttgttttattatgccctagtaacacataataatgattgctctcaagaattattacaaactagtatcacgcgcacagttaaatgttttctcaataaagctgtttataaaaatcaaatgattgattttatataaacggctttttcgtatatgtatgaattgggtgtcagtaactgttaatggctcatttatagtgagcaaattcctaacgaataataaatttaggaggattcgtgtcaaatatgtgtaatggctgatgctttggttgagctaacagtaaatggatggtgcgattactcactatcagcgcaatgataaaaataatatttatgtcatgaaaaattaataaaagtagtatacttattgttaatatgaagtatatcgatggttaatataagggtggtagtcgatacttttggaggggaacaaaatgcaaaaacgtcagttgcaacgagctaaactaactgaaaaacggacttataaaatgtataaaaagggaaggctgtggttggtggccggtctaagtactttcaccatgggaacgggattggtacaacttcaggcgatggcggatacgaccagtacgcctgtgagtcaggtggaaaaaacgacggatcatgctagtagcagtgcgacgttaaccactagagtagctaccaacacaaatgacacggctaatgcggacactgaatcgagcgatagcagtagtgtgcacgctacaactaataatagtagtggtgcggctacggctagcgacgatcggacaaaatcttcagtagcagagcatacgcttagttcagcgactgatgggacaaaagccaccaactcgtcaacgactgatctgacaaattcgacgactagtcattcaagtagtgtgaccacggcaaacgtttcggctacgagtgcagctcaaactgcgcgaacagccaacggtgcgactgatagtgccgtgagtcctaataaggtaacagcgagtgctgcggttactgaaatcgaatcagattcggttaaaacaaaagagataactaagacaactggtacggctaaggcggtcagtcttgcagccacagatacaagtacgtcgcagatcaagttgagatcggcgcgggcggccgttgccactgtcgcaacgatcagttcaacgactaagatgtatgatggggtcgcggggacaccagatcgttacacggttacactagctgatgggattaaagcgcctacggattgggcagttacgaaggatcctaacgtttatacggatattgacctaagtgactttgataagaatcaatttggtcgtggaatcggcacgtacccgattgcattttcggagtttgggttgtctaaactggcagaagccaatgatagcttagatattacagccgcgaatgtggtgacggggacgttaaccattgagcaagctccggtccatagtgcagcgattaccattggttcaacaagtattgattatggtgattctaagcctagttcatatcagataacggtcacaaacggttactttgataagtacaatgcgcccagcacatggacactagtcgactcaactagtagtggtgtggtaaagacgacttacacgattgcaagtgatagtggtgacattactgtccccacagcaactgaagctggaacctatgttttggctttgtcggcacaaggtttggctgcattacagcaagctaatcctaattatgaatttacagcagatagtattgttaatggtcaaatagtcattgctgctcacgacattattacgatgggggcaactactgttttagtaaataaaacggccagtactgttcaggttgctgtcaacagtcgggccgttagcgtgccgggtgactgggaagttcactataacgacaaactgactgattcgattgtgtataaagtaccggtttcttatacaacgtattctacggccgttgatacgagtactgtcggtaaatatacaatcacattaacagacgcggccatggcaaccttaggtcaactgaatagtggcactgtatttaataataacaatgtcggtgatggtgtggtacttgtcaaagaaagcaatgcggtcactatttcacccagtaattatggggctaaagcaagtgtctatgtggttgaagcaggtgttgttgagcctgtaacaacaacgtcaattcaaagtgcgcgggataaaggaattaatttattgtatggtcagggcctttacttggttctgccactccttaatgttgcacaatccgaaatgacggtggataaccttacagaatatgtcattattccagctggtttcaaagtggcgacgatcggtaatgggggcactattcaggttgcaaatgatccggtcggggcgttaacggctgccattgagacgatgatgacaaagaataatgtgacttatcagggattagcggttacacagttaactgattataatgggcgccaaacgttcaaggttcacctcgaccagacggctgcttacagtaatggtcttttcgagacaatggtgtacacgctcttaccgaccatcgcggttcaaagtagtggcgtgactggtggcttaattggcaaccaggtctcaagtcctgattcagcggttatatatgttaccgatgatcctaatgaaaataatggtagttattcgttaaaagatcaaaactatcctaatattgataaggtagctaaagcgctaggagtcgcggatgcggtgactataagtagcagttttactgattacttgtatacctatacactgaaggcagctgaagccgacgatatatatatgttgcaagccccagatggcagctcgttaggtattatcgtagtatccggcaacgtggggacgacttatgttcctagtcgcgaattgcaagcgataacttcttcaggtaacgattattattacttgaatccagactcaataccgcgtacacgaacttacgatagtcctgatcaaaggacctatacgctcacttaccagcgctacgtcacaacgacgactgatactgcggccaagataacgattgcaccagcttcaaaagtctatgataacaacgtcacgactgatccaagtcgctatacggtatacttgccgactgaatacacggccccaagtaattggactgctgatagcgcggcgacggctgtgggtgggacgacggcgtaccaagtcagtaccgactaccttaataccactgcaatcgatcagaacgtgggcacttacgccgtcacgctgaacagcgccgggatggcagccttagccgctgctaatccggacttcttgattgcaggcgatgtgaatgttggtgggaccctgacgattactcaacgtcccgtgacgatcaccttgccggatacgattctgtgggccaatggtcaggaacaaaatattacgccggtcattactggtgttgttgcggggcaaagtttggattacacgttaacgtcagggttaactgatccgggcacgacaaccattacggccaagctagctgccaatagtaattatcaattgacgaattcgactagtggtcagttgacggtgggagccgtaacggttgtctatcagtatgggtaccgcgacaaagcggggacactgtacgtggtaacaacggccaacggaacggcgacgcacgggactgacgttaccgctaaggactatttgagctacaccacgagtgatacgactgctgggcatgccaaaactggttatacgttacaaccagaaagtaccggttaccaagccgatggcactctagcggacgttggtgggcaggtcgtgtacacctatttagcgaacaccgaaaagattgcggtcgtttacgtcgatcaagataagaacaacgtgattttaaatcaaattcccctcagtgggagctttggcacacccacgaattatacgacagcgcaggacattgcggcgtatgaaaaattaggctacgtgctagcttcggataaggtcccagcgccgcttgattttgatcaggatactgaacagacctactacgtatacctgaaacatggcaccatcacggcgacggttgatcagccaggtaacgtggccgttagtgatttgatgaagaccagtcagcggacgattcattacgtttatgctgataacacacccacggacttagcggatgtgcttcaaacggtcacgtatacgcgcgcggcaacggtggatgcggtggatggaacggtcctttcgtacggtaattggacgaccactgtgaatagctatccggccattgagtcgccgaccattactggttacacggcggatcaaacgactatcgcggcggctgtacccgctagcatgggcgagactacggacacaacggtccgatacagcgttaattctgaaacgatccgggttcaatttgtcgatggaactacggataaccaggtcttaggttatattgatttgaatgggaaatacggtgatgctgccgactatacggtcactgctgacattgcgaagtatgcaaaattaggctatgaaccagttaactcggacttgcctgatcaactgatttataagcagaatacccaagtttatacggttacactagcgcatcggcacgtgacggtcaccgttgatcatccgggccaacctggtcaggccatcgatgctgattatccagccggtcctaaatatccggcaggcactggtcgtgattcgttgcaacaaacagtggttcggacgattacgtatcaatatgcgtcaggtgaatcagcggctgaaacggttaaccagtcggtcacgttcaatcgcacggcaactttcgacatggcaacgggtaagcagctgacttacggtgactggacagtggcacctggtcagtcagcactattggccgcggtcacgtcaccaacgattacgggttatcaagccagtgttgcaaaagtcgaagaagcgacggtcactagtcacgataagccgcgttcgattgcaatcacgtacatggccaaatcacagaccgcagccgttgcgtttgtggatgtaacgagtggtaaaacactacctacgacggtagtaactggtgcttatggcactacgaatgattattcacctgtttcacagattactgcgtatgaaaaactgggctatcaattagtttcgaataatgttccaacgactggtatcatttttaatcaagatgacgtcattaagtcatacacggtcaagttagcacatcggataacgacggtcacgccaactaagcctgggcaaccaggtcagccagttgatcccaatcatccagaagggcccaagtacccagctggtactgggcttaatgatttaaccaccagtgttcggcgagtcattaactatgtttacagtgatggtcaaactgcggcgccaaccgtcacgcaaacggtcaatttcgagcgtatggcgacttttgaccaagtgacaaaggtggtgacgtatacggattggcgtacacctgaatcagcgtcgattggggcatacgcagtcgttgaatcgccgataattgctggctacaccccgaacgcaacccgtgtggctggtgtaactgtcagcgcccaagatactgagtcgcaacaaacggttacttaccaagcaaatctggaaacggcgacggtgacttatatcgatgccacgacgggccaccgactgggcacaagcgtgacgttaaccggacgattcggtacgcaagtagattaccaaccaacgacaatgattgctcagtatacccaagcaggctatgttttgatagggagtgattacccggcaaggggtgttacttttaatcaggcgggcgtcgttcagaagtatacggtgtacttggctcataacaaaatcgcgattacggcaccagatcagctcaccaaaacgatcacgcaaacggtccactatcaggatcaggcagggcacacgcttcaagctgatacgatccggacgctgacgttcacgcgttctgggattgaagatgcagtgactggtgtggcaacgtatcgtgactgggcaccgaccgggttgaactttacagccatgtctgcgccaacgattgcgaaataccatgcgttgacggcgaccactcaggccgtgacaatcacggctgctagtgctgatgatgtccaaacgctaacatatgcgctggacgtcccaacatcgataaagccaggtaagccgacaaaaccagccaaaccgacaacatcagacgatttaatcaagccaacgacgaaaccaatcacggctgctaaaccaacgccgataaagccggcaacggttgtgaaggctgatcaagccacaactggcaaccagacgatacctaaatcgacaaggacgtcggtgccaagtcgtattaaggttgtcaaagcagctccggtatcagcggctatcaagctggaaagtaaagtaacggagccggctcacaaggcgcaatcagatacaccgggtcaattgccacagaccggtgaaacgcggcggtctgaagcagctgccgaaacactaggactaacactagcaacattattgctaggctttggtggtttgaggcgtaagcggcatgatgaataattgaatcggttccatcaacggcacaaaatataaacacttaacatcctagcatgtactgacattaagttggtcagtggcactagacttgttaagtgttttttagttagtatgaagaattggtcatgaggtgctcgcaagccgtattaataattgcgatgacggcataaataccagcccaggttgggttaagttggttatatgtcaagacgattgtattcccgaataataggcattcaacgaatagccgccagtatgatgacaatcgtgaggctgaaagaggcgccatgtagcgtgaccaaaataggatgagcagcaaaaggatgagtaagatagcgatgcgttgccaatcggacgcccgtaaaccaattattaggaatagaccaattgttgttaactccaataagaagcggatgccagcatggatgaggttaatcatcagtcccccccaggcgcgctaatagttgttgaaactttagtgcatcatcatgttcaagtgcaactgcgagttgttcagtaagactggctaactgttggaaaaagatggcctgatgacggaattcagtggccttacgctgagtgaaacgcagtgtatcatcatgacagcttggcgttacagcccgctggcgtagagctagcacttgtttgatttcagataaggcgagcccggcctgctgaagttggcgaatgagttggaatgtttgttggtcagcggcatcgtactgccgatagtgattactagcgcgtttcgggactaataagtggacttgttcgtaatagcgtaaagtatcacgagtggtatgaacgcagtggcaaaatgcggtggtattcatgaggcaatcctcctcgtatttgattgaatcgagtataacatgggggttcggtcccaacacaagtggcaacggtcagtttagttgcttgaattttagtttgttaatcgggtaagctaggcttaaaaggaggtgggaatcatgaccactatttttgatgttgcgaggcttgctaaaacctcaaagtcaacggtctcacgggtggtcagtggacatggctatgtcagcgcaccggttcgagagcgggtgttagcagcaatgcgtacgcttaattatgtgcccaatcagttagctcgtcaattaagggctcaacggacgaaaacgattgggtttttagttaatgaatatgcaccagtaatgggagatttaattaattattttactcaggttgctcaaagtgacggttatcgagtcaatatgtatcaaacaatgaatgcggctgatgaattacatgttttgaatcagttaatgactcgtgagctggacgctgtctacattgcagtacggcataatcgttgggataagattgaaccatatactaaatacgggcctattgctacttggcaacgtatggattccaataaaatctattcttcatacgttgatcattatcctttgtatcttcaaattctgacttatttggtcaatcaagggtatacccggattggtcacgtgctaaataataagcgggctagtaatacacgggcgcgactgcacgcgattgcagattttaaacaggcatatcctcaagttgatcaaagttggcaacaaacacatcagcatcaacagcacgctggtgagcaagccgctttaacgtggttgcaaacgtctaatccacctcaggtcgtggtattgtatgcggattatgtcgccgctgagtttattgcgacattgcgattgcatggtaaacgcgttccagaagattgtcgagtatttgggtttgacaatagcgaatttggacggttgatggcgattacaacggttgatgctcagcttcaaggccaagcccaaaatgcctatacttatttgatcaatcagattcaacataccagtcggccgtatcagcaactaacaccacggctaatttttcgatcttcgtgttaacttatggcttgacgtgggaacattcccacaatttatactaatcgtgttaaacaatacaactttaatacggaggtcagtttatgtcacacaatgcattgaaattagttaccattggtggtgggtcgagttatacccctgaattgattgagggttatattaaacggcgcgagcaattgccaattaaggaaatttggttggtggatattgaagcggggatggaaaagctaaagatcgtcggcgcgatggcgcaacggatggtcaaagcagctggtctggattgggaggtacacttgaccctggatcggtaggcggcattgaaggacgcagactttgtttccacccaatttcgagtaggacggctacccgcgcgtattaaagatgaacgtattccaaattattatgggttgattggtcaagaaactaatggcgctggtgggatatttaaagcttttcggacagtaccggtaatcttagacattgtggctgatatgaaaagattgtgtccggaagcatggctgattaactttacgaacccaagtggcatgattacagaaacaatcagaacatacggccattgggaccgtgtcattggattatgtaatgtcccggtgatggcaatgttgagtgaaccagaattgattggtaagacactagatcagcttacgtataagtttgcgggtattgatcattttcattggcatcgcgtttgggatgaatcgggtcaagaagtgacaatgacgattatcgataaactatttggtgatgatgatgccggcctaccgactaatatttttgatgtgccgtttttcaaagaccaactggctgcaatgcggatgattccgtgtgggtatcatcgctactattaccgacaggaagaaatgaccgcgcacgggctggctgagtatcatgggaataagactcgggcacaacaagtgactcagattgaagaagaattattcgaattatatcgtgatcctgaattggattataagcctaagcaattagctgaacgtggtggtgcgcactattctgatgcagcctgtgaggcgatggcgtcgatttaccaagataagaagacccatatggtggtttcgaccttgaatcaaggaagtgtgccggacttgccgagtgatcatgttgtggaagtttcggcgcaaatcggtgctgctggggcagttccgatggcgtttggtcattttcaaccagctgaacgcggctggctacaattaatgaaaaatatggagttagtgattgttgaagcagctgttaccggtaactatggtctcgcattgcaagcattcacaatgaatccactaattccgagtggtgcgaccgccaaacgagtattagatgaacttttgattgcgcatcaagcctatttaccgcagtttgccgataaaattcaagcactaattgcttccggtataacgattcaagatgaggtagctgccaagttatcagaagtcgcccaagtcgtatcagattaagcggacttggcatgggcgtgactgcataacgacggttatcgttagtaaaggcgttactatgccaagcattaatttttaatgaagtgttctgggatcttagagaagattgcggaacacttttttatgggttctggttaccagaaattaataaaaatcaatctatgccttttatctatatataattattaattataagtatttaacatattcgttttagatccgtatactgagtttaattcatgagggagggtgacatcatcaaaccaaagtatttagatcaggattatttacaagctattcagccaatcgtggacgcgaatcagcatcgaattcagcaattaaatgcaacacaacaacctagtgcaattcgggagttgttagctgcaatcacggaccagccgattgatgactccgtagaaatccgcgtgccactgtggacagactatgggcggaatttaaaaatcggcaaacgtgtttttattaatgataatgttcagatcactgatttaggcgggatcgaattagcggatgacgtgctgattggtccgggtgcgatgttactatccgttaatcacccgttagatcctgctaagcggcatgcggttgaagttcagccaattcacattgaacgaaatgcctggattggtgctggtgccaaggtattagctggcgtcacagttggtgaaaatgctgttgtgggtgccggcgcagttgtgacaaaatcagtgccagcaaatacggtggtggccggcgtccctgctaaagtgattaaaacaattgagcaagtagattaacggaggttttataaagatgagtattaaaggtaaagtggttgttattacgggtgcgtccagcggtattggtgccgccacggccaagttgttagcggctaaaggcgctaaagttgtactgggggcgcgtcgagaagagcggttacaggccttgagtcaagcgattggtgacaacgcggtctatcaagtaactgatgtaacagatcggcaacaagttcgcgctttgatcgacttggccgtttccaagtttgggcgtgtcgatgtgctatataataatgccggtacgatgccccaggggaatctgagtgaccgtgaatacgataagtggcagatgatgttgaacgtgaatattatgggggttttgaatggaattggtgaagtattgccaatcatgcaaaagcaacatgatggtttgattatcgcaacggattcagttgccggacacgtcgtttatcccgcatcagcggtgtataacgggactaagtatgcggtccgggctattatggaaggcttgcggcaggaagaaaaggggcacgggattcgttcaaccatcgtgtcgccaggtgcagttcggacggagttggtcaatacgatcggcaatacacaaattcaggccggtatcagtgagctgatgaatgcggacgatcgccaagggttggctttaaatccggaagatattgctaacgcggtattatttgcgattgatcagcctaaacacgtcgccattagtgaagtgttagtacggccagcacaacaggaagtttaatcatcagaatgtcttagaaaacgattgaattaaaaaatcaccattaccgttttatcatattattgataaggcggtaatggtgatttttgattatactcgcgattaattcagttatgatggcattgaaaatgaaatcacaactgaatttttatagataagttatggttaaccgtacagccggggcggcttattacccccgcactaacaggtaaataaaatatggcgctccaatcaatgcgacgagcacgccggctggcagttcagtggtcgtggtgattagttttcctaaggtatcggcagctagtaataacgtactccctaacagaccagctaacggaagctgatagcgttgtcgggatcccacgattcgtcgtgccaggttgggggtaatcaggccaatgaaactgataccgccactaatggcgacactaacgccggctaacatggcggccacgctaatcaatcccaattgttggcgtttcaagttgattcccaatgtttgggcagtggtcgtaccgagtgtaaaggcgtcgagaacgggtaattgaatgaatagaataccactaccgactgccaaccatggaagcgcccggccgatataagaccaatcagtgccccacaaactaccggccaaccaattcatgacaaattgataattatcaggtgataattttaacgtcatcaacaccattaaggctgaaaaacagccggacaaggcgacgccgaccagtaacaggcgcttagacgagatccctcgttgacgctgattcgctaataaaaaaatcagggccgtacttaaccatgccccagctaacgcaacgataggtaaactcagcgttaacgaagcgttggtgcctgcaccaataatgagtaacataacggctagtccagcgccgttattaattccgagtagactagggtcgaccattggattgttggtgaccgtttgtaagatgttaccggataatgccagggcccagccaaccatgatggcgagcacgatctgtggtaagcgaaagttgactaagactaacatgtcggtcgcattaccgtgaccagttaaaattcccagcagagcgggccagctgatggtcattgtacccgtactaaggttgagaatcgctagtccgagcatgctagcagttaagagcagtgaccaaataattaagcgacgattagggctcatgctttcatcggctcctttcgtgcaaggtagatgaagcacggtaccccgattaaggagataatgatgccaaagggcgtttcatgtggcggattaactagccgtgcaatcaaatccgcaccgaccgtcagtgttgcaccaaggatcaacgttaatggcatgctattgcggtaattagcgcccactaaccaacgcgccatgtggggaatcatcaggccaacaaaagtaatcgtaccaactaatgccaccgagatcccggataaaatgacggcacagatgagagctaggcctcgcagtaatgggagacttttccctaaactctgtgcattgtcgtcagtaagataggctaagtttagttgcggtgcgagtagtagggtcagtagcaatcccaagactagtcctggaccgagaaactttaattgtgtccagctgacggcacccaggccaccgaaataccagaacgcgaggtcctgtttaagctgcaacacaagggccagcccttcgctcagagctgttaataggctactgattgcaatcccagcgagtaccagaatcgtgggatcaagttgaacatggcgggcggtgctgatactgaaaatcagtccggcactggctgccgcaccaataatggcccaaccagtcgtttgtaaagttgataactttggaaaaaaggctaaacacagcgttagcattaagcccgctcccgcgttaatccccagtaagcctgaatccgctaacgggttacgcgtcactgcttgcattagggcgccgctaccagcaagagcggccccaatcaacgccgctccaaggacgcggggcacacgaatgtgccggataatttgttgatcaagattgccggtgtgtgtggtcgtcagggcgtgccagacggtggccgtacgcatctggtcggcgccaaatcgcaaactgagccccatgacgagaatgagtacgccggtactaagtgccagccacccccaatatctggacgttgacttcatgcgggggccacttcctgacagccgttataggtcaaaatcagtggggtaccgtggtagtcaacgagggtggcatcaatattgaaaattgtttttaagttagcggccgtcatgacggtggacacgggaccgtgggccaaaacgtgaccgtccttgagcgcgattaattggtcagagatgcgagccgcatggttcaagtcgtgtaatgccataatgatagttcggtgggcctgttcgttgagctttttgacgagttgcatcacttctaattggtgagtcaaatctaagtaggtggtgggttcatccagaataatcgtgtcagtatcttgagcaacggccatggcgatccatgcccgttgacgttgtccgccagaaagggtgcttaggggccgttggcgtaaatcttggaggctggcctgagtgagcgcccattcgattttttgatggtcagttgtggtgagcccacttaacggccgccgataaggtaagcggccaaaactcaccagttcttctacggtgagatcgttagccgtttggttcgtctgtggtaagactgcaatctttttcgcaaaagttttgcttttgatttgttgaatgttttgatgatccagtagaataacgccggttgttggtggcaataggtgggcgatggcccgaatgagggtcgatttaccgctaccattcgggccaatcagcgtagtaatctgaccatgcggaatcgtaattgatagctgatcgacgataaccttgtcgccatagccaatactaatattttgggcttcaatggtattcacaaataggattcctttcttaaagttaagcgttcaagggagattcacttgataagttaactaactttgtttagttgtgcacaatcttgttttgcttgttcgtttatcggtaaatgttattaaaccaactgctaactaataattagtgttcaattaataatcttatcttaaatgttttcattgacaattgatagtgttttcactaataattttggtagcgcttgaaaggtggagacagttgtgacaaaacggtggcaaattgtaaaattgggattagtattggggttaacgggaagcctactattaggggcgtgcggtgcgaagcagccgacaagcacgacagttacacgaaccgattatttgaagcataaggtcaaggtgccgaagcatccgaaacgggtcgtggcgagttatctggaagatgatttagtggctttaggcattaaaccggtcgtgcagtggtcggtcaaaaatggtagtgggacgcaggcttacttgaaaaagcagttgaaaggggtgccgctaattgattattcgttaccatatgaagcggtgaccaaggccaaaccggacttgattttgatggggacgagtagtgcggtcgccaatggcaagtatgcgcaatataataaaatcgccccgacctatgtggtcaaaaatgggactacggtaacgtggcgccaaactttccttgatgtggctaaggcggttaatcgccaggctaaggccaaaaaagtccttgctaagtatgacaagcaggtccaaacgacgcgacaagcgttgaaaaagtctggtcagcataaagtggcggtgttgtgggtcaccaataataccgcctacatggtcaatgacaattcagccagtggagccttactgtatcaagatttacaattgggtgaaccaagtttagttaaacaagtgtctaagtcggccacggcggattggtcggcggtctcgttagaaaagctcgctaagttagatgcggatgatattttcttagtgaatagtcaaaagagtgcgtcgctatttaaggacccactatggaaaaatatcaaggccgtgaaaaacaaccatctgtaccagtatggtgacagtagcagttggcagtattcgggaccaattgcttattcacaaatgattgatatggtgaagacggacttgttgaaataatattgaatgtagtgatgtgaattaaaagtactgtgttgagtttgatgaatggcagtgttgaattgaaactgcgaaggacggttttgttaatgcttggcaacgcgctgacaaaaagtttaggatgaaaaatggcaatcttaggacaaaaaatctgggactggtggtcagttgatataattatgaagggtggttaattaataagtgatggaggtgctagcgtgagaaaattttattttcaatatcataaacaaattagtagttttattaatatcaatcggtttatgttaattttcgaatttatcctacttttcgtgataaaaggtggtattgatttatataatcagatgccatataactggcattattatttatccttgttaattcattatttcctggggactttggctttctttgcattattgctaattattgaatgtatttggcataagttccatttacaataggtgataatattgatcctacgagtagaatagtggatagtcttagatataatcgcactttatttttaacccattagtctgttaaaaatcggatgataagaatctttagagattcttaccatccgattttggttttgaagcttatgctgaaattccttttaaatgttatttagcataaaaccttaatttatgaatcacgtgctttatcatcaaacacagctaaagagcgctcttcagaaataaagcaatcaatcagtaattggcaaatcgagtgaactgcttttaagtcgggcttgatagaagagactattttttcgaattctgtgcgacttatattaattcgcttgatttgtttctcagaaagaatgttcattaagtcagcaattttctcgtttgaaaagtcataattcaaaaagactaagtcactacttttgaagttgagtttttcagttaatccgtttagaacatttaagaagagtgtttctttagagaagatttccataaatttcctccttctcgtcttatactagccattttaaggcagtcactacccagtatgcaacagagcgcgccgtggtacttttaataccactactaattaacgttgataatataatttcttatcatataaaaacaagaataatttcatttgacggtggattgacttgcaaatgctcactcacgaaagttaaggagttaaggagcaggttagaaggttcgaaaagtactaataccatttaaatatatatcgtaattggatgaaaatgattgtgctgtgtatggctatgattcttgaaaattatcattcaagtatgattaattaaccaacagaaatgagcgctatccgcttattctgaccactagcaaaaaaataattaaatccgcttgacttatagtcggctctaacaactattattagtctcgttggcagatgtttttaactataattcatcgaaaaggggataacaattatgaagacaattcaaatcggcgctagtcagctcaaagcgtctgcggttgcgctgggtattatgcggatggttcgtttagataccgatgcggcagcgaacgtcttagagaccgtccatgaccggggtattaactttattgattcagcggatatttatggtaacggtgattcggaacggattttcgggcaggcattaaaacagtcgagtttaaagcgagaagacttttttattcaatccaaaggtggcattgtgcttgatcctgagaagagttctggtgaactagtcttcgggcaacgctatgacttttctaagcagcatttgattgcaacggtcgataaaatcttgcaacggatgcagctggactacctagattcgtttctattacaccggcccgatccgctgatggatcccgccgaagtcgccgcggcgtttgatgaattgcaagctgctggtaaggtgcgccacttcggtgtttccaactttaacccgatgcaagtcgagatgttacaagcggcaatcagtcagaaattgatgatcaaccaattgcaatttggtgttatgcacaccggcccaattcagtttgggttgcacacgaatatgcaggatacggctagccttaatcatgatggcgaaattatcgaatattcgcggctacaccacatgacgatccaagcttggtcaccctatcaatacggcatgtttgctgggacctttattgataatccgaagtttccagaattgaatgcgaaattacaggaattagctgatcaatatcatgtgactaaaaatgcgattgcgacggcttggattttacgtcacccggccaatatgcaggttattttaggttcaatgaatccgcaacaccttgatgagagcattgcggggaccgatgtgacgttgacacgccaggaatggtatgacgtttactttgcagcgggcaatgatttaccttaatggaaagtgaccagtaattaaaagatccccttgtggataactgtttgcttaatcagttgtccacaaggggatctttttagttcgggggtgcccgtgctttaattggccgtattcgtccatttgatcagtacggactggttgattatggtttggtgacgattcctaggtcaatcatagattgggcggttgcaataatcgattccgcagcgggacggggatgccagtccaacaatgtttgggctttatgattgctcgtttccgcgtaggtgccaactagtgaggcgaccattcgcaattctggtcgggccttagcagctagcttaaccgctgcattggggatggttttggttggtagctgactggcaaaagctggaaaggcctgtcttaagacactcgcaacgtcaagcatggatagtgtttcacccgttgtggctagaaaacgctcgccgttcgcttgcggtgcggtcatggcaagcaagtgcagactagccacgtcacgaacatcaacataaccggaatcaacgtttggaacggctttaacttggccttctaagaattgttggatttgaatattggaatgtgaatatttggcggacaacaccggacccatgacggcaacgggattgaccgttgttaattctaacccgcggccctcatggttaataaagtcccaagctgctaattccgcacgtgtcttggattcttgataaggatggattgctttccagttgagatcagaccagtcagcttcagtgtagggggtcgtacgatttttgtgaccagcaaagatggccccgtacgcagacgttaacacgactcgtttaacgcccgcatcacgactagcagttagaacccgccgaacaccgtcaacggctggtcggatcatttcagctttgtttttgaagttgagctttggggttggggaagcgacgtcgatcgcataagtggctccggccatcgcttccgaccagtgttcatcatgcgccaggtcggccacaacaatttcgagagctgataagtcggtgataccaccattggtcagcatttctttaataacgggtgctttggctaatgagcggaccgttgtgcggacggcgtagccttgttgtaataattgacgaatgatatgaatggcgataaaaccgctaccaccagtgacgacgactaattgtttttgcatgggactacctccaaatgaatttatgaattactgttacacttgtaacgtctgtgccagtatcttacaatggggtcacgacgaatacaaggtaatcacgagcatctgtgacagaatggaggaattgttatggcagcgaccaatcacgcgcaagcaatcaaaaaggattcacaaacttatttaaccacggccttattacaattattaaggactcatgatttagatacgattacggtgacgcaagttgtcaaacgagctggggtcagccggatggccttttaccgtaactttacgacactcgaagatcttttgagcacgtatttcgccccggcgattgcagcgcggtttcaggacgtcttgcagcatgtaccggccaatcagaagttattagcgatgggtcaatttttcagtgattttgcgccgacgttacgactggctgagcaacgtggttttgaaaatattattcaacaactttttaacactaatatgactaattattaccaaacaacgatggcaaatgggacgctcacggcggtgcagcttaagtattggacaagattcatgagtgccggggtatacgcaatttggcgcgaatggctactgggcggacagttggagtccttaacaacgattcatgaattactagcaactttgcagacggcaacgatgcaggcgctgactcaggctcaaaaatgagcagtggaggaatgctcctaaattagcgatgttaggaggtcggaacgccgatttttgcgtgttgattgggtacttatgagcaattgtaaaagccacctagccatgcaccggcagagggagctgctccgtgtcaagtagacaattaaacataaaaaaattcagcataaaaaaatttcttattgaaattaggcctagttaaactcaaaaaaagaaataagacaaggtgggaaaaaatacgattgataatgcaactgttcttactggcatcgataccggtcttagtctttagtgaactcgtgctaaatactgattaccagtacatgcttttggtttcttctattatgaagtgtgttggtttcatttcttttgtaattgcgtttgtggatagtttaggtccaataaaggagatgcagcagttggttgctggcgcacaaagcagtgatactttagacagtgataaaaaggcgctagcggtgacgagctttaaaaaaattagatggatgctgatattatatcaggtattaaaagtacccttgcttgtaatttttttgagcttaagtgttgattaccggcgcgacggcttcttttcataaaaatttgaatataactcatttttaatcccgttcctttagctattcttctcgcacgttaatcgatagcaatcgtcaagtggattaaatctgaaaatcttatcacctgagaagaaagggcacgttttgacagattacccagatgaactgttattagcattgtttcacggccgaatcttgaattaagcaacgacgactgttttatataaattgcttttcttactgattcgtcaattggtctttttgttgattggaaatcaaggtaagcaggttatcgagttaaaagttgtcgatacaactactccgcataggacctaatatgttaaatagttcagtttttaagacacgttaggcctgcgcgcagagtttgctgatcgtttttgcgtttaagctgttaataacagtttttgcagttgcttaaagttatccacagtgtaagttggggcaattgttgtgtcgttgtgcgcatgctgtggattgtaccagatactaggtaactggacggtggccgctcccgcgatgtctgaacgcaggctatcaccaatcatgacggtattcgtggcattcatgtctgggtattggtcatgaatagcgctgaaaaagtgtgggttcggcttggcataaccgatactttcagagatgaagatatgatcaaaatagggcgtcatatgggcacctgccaagcgactgagctgggtgtgtttgataccgttagtgccgacgagtaaggtcagcccagcgttggtcagcgtgcgcaaaagttcgtgggcgccgggaattacctgataactgtgcgctaataattggtcgtattcttgttgaaccgcaggaccgtcaacggtgatgcccagtgtgcctagaaagacttgaaatcgttggtctaacaagctatcacgatcggcaccttgttcgatttgttgccaaacagtttcgttataggcctgatactcattttctgcacggcgaatatcagtgacgccatgatgctgaaagacggctgcgaggttagccgcttcagcgcggtcaaagtcaaggatggtattatcgagatcaaaaattgcgtattgcatggaaccactactttcaataggtttatttaaaccatcatacagcaattttgaatggtgtggtatgcttaaagtatcatacttaaaaggaagttaaacatggaaatcgataatgacccagcgtatcaacaaatgattaatggtgaattgtacttagaatcaccaatcctacagcaacgtcggcgagacgtgcggacgaagttaatgcaatataatcagattgctgataatgatgaacggaatactaagatgaaaagcctcttacgttcagccggtgaccggttcttcgttgaaccgacctttgaatttagttatggcgtcaatattcgtatcggcaatcatttttatgctaaccatggggtcacgttatgtgatgaaggactgattacgattggtaatgattgcaaatttggccctaaagttggcttgtacacgcctgctcatccattagacccaactgtgcggcggactgaagcggaacggactgcaccgattacgattggtaatgatgtttggattggcggtagtgccgtgatcttacccggagtgacgttgggtaacaacgtgattgttggtgccggtgctgtcgtaacgcattcatttccagataacgtcatcgtagtcggtaatccggcgcgtgtcttgaaacaaaatgtaccgcagtcataattgacaattacgcctaaattgatgaaaataagggtgtagtcagattatcagagaatggggagtggagccatatgtcagagatgagtcctaaggaatttaagcacatcttagtcggggttgatgattcggatgacgcgcagttagcgtttcggtacgccattaaccgggccaagagtgacggtgctaagttgaccatcgtctcgattttggaacaggataatatgaatgtgtatgaggcgatgagcaaggactttgttcatggtcaacgcaaggatttggaagaacacgtccagcagtatcagaagttggcccgtgacttcggggtgacggatgttaacgcggtcgttgatgaaggtgaccctggtgaaaccatcgtgaagacggtgattccagcgttgaagcctgacttactagtcattggctcagttgccaagcatggtgttcgtaaatacttcggttcgcaagccgcatatatggcaaaacatgcaccgatttcagtactggtgattcggtagtgataagatgaattttgattgatcaggccttccggttatggagggctttttttgttgcgtcttgagtatcattttccggcgatggtgttgatgatgaataatagtggttgtgtcttgaataccgttgttatcaaagcagtgttcgtttgagcaaatcagatgtttgctagcttctatgacttcgtggtaaagtgaccgtgacatgtcgttgggattaactgaaaattaagttgtgatggaaaggtgtgctgatagatggaagtgagtattcgtaagattggcaatgctcagggaatcatttttcccaatgaactgagccttgaagtaggggcacgttatagaattgagcaaagtggtccggcactgattatgacaccaatcaattcggaactttttgctaatccagatgattgggtgggttttcgtgacagtatctcctaagcagaacgtgaatgggaccagttagctgactcctaaaatggttagtgacaggcaattatagtgttagttacttaaagcgcatcagttttttgatggtactagtattctgatgatgttaaataggattgttcagtagggcgctgggcaatccttttttattgaagcgactctttttgagggattgttttaacaaagagtaaaggaggttaagtataacggataaaaaatagtcattgcaccacacgttagtggcgacagtacaaagaggacggcggcttacatttgatttttacaaaaaacaattagagatacaattaatatcagaaaaccaggtctagcggtggccgatttcctgatattgcttttcataagtaaaacttatcaatgtgagctgaatttgaaattggtctaaaagacgtttgcttgtaagatatgacttgtaagttaaggtgaatcaaaacaagtaaagaggtcaatgaatatgaatgacgaagtaatcgtacttttcggtgccggttcaatcggcgaagcaattgttcgacgtgtcgctgccggcagaaatttattgttggcagactataatgaagcaaaattagttgaaatgaaacaacacttgacggaagctggatttaacgttaagaccatccaagcggatctttcatcacgggaatctattaagacagtggttgctaaggcacaatcgcttggtaagattatgggattggtcaacgcggctggcgtttcaccatcccaagcgagcccagagcaagtgctcaaagtggacctttacgggactgccgttttgttagaagaatttggtcaagtcatggctcccggtagtgcgggaatcgtcatttcgtcgcaatcaggacaccgattacccgccttatcacaagcagataatcaagccttggccatgacaccgactgaagaattattggatttaccaattttacaaccggacgtgatcaaggattcattggcggcttatcaatatgcgaaacgaaccaatgttttacgggtcgctgccgaatcggttaagtggcaagctcgcagtgcacggatcaacacgatcagccccggtattatcatgacaccattagccgttgacgaattgaacgggccgcgtggtgcgggttacaaaaagatgttcgagtcaatggttacgaagcgtccaggaacacccgatgaaattgccaatttggcggaactcttaatggatcgccgtggtgcctttatcacagggagtgatttcttggttgatggtggaattaccgcacaatattggtatggtaatgtttcagaagttcgtaacaatggcgtccagaaatagaattttaaggggagtttattatgaaagcagcaacttttattgaaccaggaaaagtcgaagttaaagaatacgacaaaccaactattcaaaagccaaccgatgcaattattcgggtgctccgggcctgtgtatgtgggtcggatttgtggtggttccgcgggattttacaacgccaagcaggttcaaccgttggtcatgaagcaattggaattgttgaatctgttggttcagccgttaaagatgtacaagcaggcgatttcgtgattgcaccgttcacccatggttgtgggcactgtgccgcttgtttagccggctttgatggggattgcttaaaccaagaagccggcggtaacggtggctatcaaggtgaatacttacgctttaccaatgcaaactgggcgttagttaagattcctggacaacccgaagattattctgacgacatgctgaacaactttttagccttagctgacgtgatggcaacgggtttccacgccgcaactagcgcagaagtcaaaaaagatgataccgttgttgtgatgggtgatggtgccgttggtttgagcggggtgctttccgcaaaattgcttggcgctaagcggatcatcgcaatgagtcgccatgaagatcggcaaaagttagcaaaagcatttggcgccacggacattatcgctgaacggggtgatgaagcggttgccaaagtgatggccttgaccgaaactggggctgacgcggtgcttgaatgtgtaggtactgaacaatccgttgacacagcagtcaaagttggccgccctggtgcggttgttggtcgcgttggggtcccacaaaaggctgaaatgaataccaataatcttttttggaagaacattggcttacgtggtgggattgctgctgtaacgacggatgacaaacaagttttgttagatgctgttttgacggggaaaattcagcccggccaagtctttacgaaacggtttatgttagatgatattcaagctgcgtacgaagcaatggaccaacggaatgcgattaagtcattggtcattgtcagtgataaataggagggaaacatgaagaaagttttaattgttggtgcaacggggactattggcggtgcagttcgacaaacgcttttgaatgaaaccgataatcagttaacgttgtttgctagaagtgccaatcgattaaagactagtgagcgtgaaagtgttatcgctggcgatgttattaaagatagtgacttagacaaggcgattgcaggacaagacgttgtttttgttgccttgagtggttctttaggtcgctttgcccaaaaaattgttgcggcaatggaccggaataaggtttcacgattgctgtttattacttcaatgggtatttatgatgaaattcccgcttcggttggtgctagtggaaatttaagtagtaatccagtgctacgcacttatcgggaagccgccgatgttgttgaagcttctgatttgaactacaccctgattcgtccgggctggtttactggtggtcctgttgattatgaaatcacgaaaaaaggcgaaccatttggtgggcatgatgtctcaatcaattcaattgcggattttgtcaagaatgcgattgtcgataatgattattatgcacatgatagtgttggactaaatgcaaaataatattcaaaaggtcattagctagatagctagtgacttttttcgtttataagcatggcagggaatcggttcaggttctgctgcaaaacatttctcaaattgttgattaaggttatactaattaaaataatatgacaaatttgaacattcaaagataattttgtaaagattgaggtaccggtaatgtttcaacagatgcagtattttatcgcaatcgttaataatcatagttttactcaagcggccgtggactgccacatttcgcagtcagcgatttctcagcaaatgaaggagttggaaagtcaacttggtgtgaagttattgaatcggaaaggacgcagctttgaagttactgaagcgggtcagtacttttatattcatagtcaggatattttggcggatgtggaccaacttataaagaaaaccatcaaaattgaaaagaatgatgaggtcgagttgcgggttggctatttaagaagttttgggactgctgagtttttacaaactgtttcgaagtttactcaggagtttcctaaagtgaaaatcaaaattagtagtggcacgcacgaagaactctatgaattattacagacaggaaaaattgatttgaatttttctgatcaacggcgggccttatccaatgaatatcaaaatgaatttttgactgctagtgagtttatggttgccgttaacaattcgttgccagttgaggcacaaaaaatcgacgttgctgacttagtggatattccttgtattttgatcattgatggtcatcagcaagtctcagaagaggagtattatcgcaatgtttttggtgtcaaaagtgagtttgtgattgctaaaagctatgacgaggcacaaatgttgatcgcgtctaatcaggggtatttgatcatcaatcagcggatgagaacacaattagataaagatattgttaaaatgatttctttggttaaaggggaccgaaaattgattcagaactattacgcttattggcaagctaataattcaggttattataccgaaacttttgctgaattattgaaacaaacctttgcataatttttacttatgaatgacccttgatttctgaatggttttggcatagaaaagttggtatcatgcttgatgtaagtaaagaaagcgtggtaagaatgacggataaagaaataattattcaattgtatcgtgatgaaaatattgctatagttcagaaaaacctcagtcggttaaatgaaattttggcaccaactatgaagttaacccacatgacggggtatgtgcagtctaaattggagtggattgaccaaattcaaaatgaagaaatgcaatattttgcttcaaaagaagataccatcaaagctattcaaattgaaggtaaccgggcaagcttaattggtcagaaccaagttcaagcaagaatttggggtggtggtacgcatacttggcggttgcagatgcagatgttttatgagaagaagaatggtgattggttcattagtgcgcagaaagccagtacctactaaagcgactagtgattagtggtcagtaaaacggtcgcattaggaaaatagtatttgttggcttggctagactgtcaactaaaggcaacacgcctgtgctttgtgacaattcctgaatagaatatattaagcgaaccataatacctttaatttctgatgactgtggcatataacaattatggcgattaagaacaatgttcgatattatacatctaacgctactgatgaagagaaatacacaatgatggtgttaagcttaccatcaaaggacgtgtggtgacttgatgagtattcggcatggcgatttttcgctaattctcggttagccaaaatgaacgagctgttgccgcacaataattaaagtcggggtaaggatgcacatctgattcttatcctgattttttgtttgccagctgtatgttttaaaatgatagttgtttcattcttgatgacaattctactcaaattcatattaaacaagtcctagagtccgtttgtccggccaagtttttatgctaaaatagttgaataatctaaaaaactaacggagaattaaccatgaaatcaatcaccttacacttagtcgttgctggagcaacgtactttaatcaacttgaccggttccagggttggagcggcacgccgttgacggcgactggcgaacaggcgacggccaaggttgcgcaacagttggcgtcgacaacgttcgataccgccttcgctagtgatacgagtcgggcgattcagactgcgcgcattatcttagactcacgagtacaacccgttaagttgcgaacggtagtcgcgttacgtgcgccattctatggcggctttgaaggcactgaacgcgcggcggtttggtcaggatttgcgactaagctaggctatcagagtgtggccgcttttgccgcagatcagacccccagtgagctacagacattgttgcacgatcacgatgcggatggattggcggaaagtgggcaggagttctgggatcgctatcaaaaggggttacaacaggttatggcggcaacgcctgatcatggtcaggtcttgttgattgtggacggcgcaacgttgcgaatgatgcattacgtcgcaactggtcgtgcggcaacgagacaggcattggcaccaagtgaggtgacaacgatggtttacactggggataagttgactgtaccggtcacggaataagttatccactgtggacaactagtggcttgcggtttatacaaaagtgcgctactgtgaaaattgagtttaaaaattttaacgaggagcttttaaaatgcaagttaatgttattacgagtacggtggccggccaagagacggtcgcaactgcggatgtgcaagctttcatggccgccatggaaaaacaattgggcgcagatttcaacttcacgttagatacagattatggtcagagtttgacggaccatagcgcggacgtttacctagtttattttggctcccaagcgaacttatccccagaacaacggtcccaaatgatcatcttctattccgatgaagatgtggctaacttaacaatcggacgttttgtagatatgctacaacagttaaacaagcggtagacactgcgttaatcacaagttaggaagtggctccatgcaattactaattttaggtgttattgcaattgttatctttatcttagaagagtacctgtttacggctagtcgctacttttgggtcggcggtatcgttccggttttatggacggtttttttggcgtaccttgtcgtggtcaatgccatgaacttaacggtgcgcgagtatgctttagcaattattgcggtcatcattccttatgtttgttggggtaacggctatcaacggcatcagaggcgacagtcatgaaaatccaaccgatagcggcagctcaaattccacgggatttactgttattagctgatccatcttgggcacaggtcacagcgtacttatcgacaggccaatgttatggttatcaacaagatggacaagtggtggtgttgtcgtgttgacaacgtttaaaacaagggtgtgggaagttaaaaatattgcggtggcgcccgcctatcaacatcgcggcattgctaaggccttactagcaacggcaattgcagtctgccaagcagcgccaacctgtgatgaactgcaaattggcactggtaattcatcgttgcggcaactagcgatttatcaacacgctggttttgagatgattgaagtgtgggtcaacttttttgtggataactatccagacccgatctatgaagctggcttgcagtgtaaaagtatggtgcgattgagtatgtcaacaaccggggaggtggcacaacgtgtggaaaacgagtcatttactaattagttggttttacggtgcaatcgccgtcttcattatcatgttttttacggcccgtcaggaagtcaatcggatcgtgttagaatttaatccgttcgtcatttacagtattatttgtgcgctcgtgctgtttccaattgtgaagtatcgttggccgcgggtgtttcaagtctggcgtaaacaacccaaggaaacaccgtcaacgcgaccagacgatgagcaaatcattcaggactctggccgaccatggtcagtagcagccaagcggacaaagcccaaacctgttccaaccgcattaacgccgcaagtcgaggctaagagtgacttcatggatggctttatcaacttctttaagaatattttgatggcagtgattttggttcctttaagcccaattatttgtgggtattttggggtccaggattggcgtcagcgccaaaaatagtcgagctgataatctgttcagaaaactgatcaaatcaattgaagacttatgcagatacggtggataacggcattaagttattaactgtggataaaagtctggttaacaaataaacgaatcaacaagttgttcataactttgttgattcgtttatttgttagttttgaaaatgattgatgtattgttgccggttctgcctaatgacgccaatgactttgcatcggccataaatgaggacaatgcaaatacagacgagtcatctgtataacaaaaaagcaagtcgcagttaacgacttgctgataaggtgttcaaatcttaaggttggtagttattaatatattgtttgcggttctgccatggccatgctttgacgaccccaatcatcttgctcttaggaacgagcccccagtaacggccatcgttagagacgctccggtgatcaccaaggacaaagtagtaacccttcggcaccgtattgttggtcacggacttggcccagccttgatcatggctcaaactattgagtgtccaaccagtgaacttactgtgactattagccatgaaggacccagtcgtctgttgatacttatttttgagataggtttgcttgactaatttgttgttcacgtaaagtttaccggaacttgtgtagcggaccgtatccccaggcatcccaatgacccgcttaacataaacggcgtttttgtcggtctggttcggatcgagtccgtaggcgttgaagacgacgacggaacctgctttgattttgctagtcttaaaagctacgacgcgttcgttattttgtaaattcggttgcatcgaagtcccatcgactttgaccatagtaaaccagaactgacgaatcagtagggcgatgatcaagccaatcgcaatcgggaccacccagctcataatgcttttaaatgttttcaatggttaaaactcccttaattgtgtgtatacctctcattataaacgataatgattttttcgcagtataaaaaagcttaaaagttcaacgatactcaaaatgggggcggttgctttcgagaatgcgtgttcatggtgataattgcgtgctatgctggtgaaagtgaaatgcgattgatgggaggaactgggagtatgaaaacacagaaagaacgaatgctggcgggtgagttgtacgttgctgatgatccagaattaggacgtgaaaatcatcgtgccaaacggttagtacgggaatttaatcaaacaaccgaagcccaaccagaagaacggcaacgattgttaacggcaatgttcaacaaaattggtgacgggggctatatcgaaccgccatttcataccgactatggaagtaacacgacaattggcaagcacttttacgccaattacgatgcgatttttattgatgtgggtcggattacgattggggacaacgtctttatggggccgcgggtcggcttatatacggcgggtcaccccattgacgccgccattcgtgctgaacaactcgaatatggttggccaattacgattggacacgatgtttggtttgggggcaacgtggtcgttaatccgggtgtcacgattgggagtaatgtcgtgattgggtctggttccgtggttactcatgatatcccggataacgtggttgcggtcggcaatccttgccatgtcttacgagaaatcaccaccgccgaccatgaatattgggctcggcaacgggccgcctattttgctgatcgtgatgatgattgatagaaattaatggtactgtgttcatgtcattagagtttggattagaaataaggccgcgatatttttaataatagacattacaccccctcagccttaaaattaacttagaaacaggataagaaagaggcggtaagcgcaatgctaaaagatgatcagatcgtgtgggcaattcaccaaatggaagcagacatcggaccagtggggccttccctggactcgcggacgccgtttcagtatttgatttcagtaattctgagcgctcaggcgaccgacgtctcggttaacaaggtgacgccggtgctgtttgagaagtatccagaaccaaaggacttgatggctgccgatgttgcggatgtggaagcaattatcaagagcgtcggattatttcataataaggcccgcaacatcattaaaacggcgcgcattgtccatgaagaattagccgatgtcgtgcctaccgatcgtaaaggcatcatggcgttaccaggtgcgggccgcaaaactgccaacgtggtattgagtgacgtttttgaacaaccgacgtttgctgtcgatacacacgtctcggcaatctcgaaacgcttgcactttgtcgctcagaccgcgacgccgttacaagttgaacaaaaaatcgtgagtgtgttggcaccggcagaattacatcaagcccatcacacgatgattgaatatgggcggaagtattcgatgaagttgacgccagacaaagaagtttgtcaattgatcattgactgtgacaagttgaatgaggaaaatgaagcgttgatctagtagtgtggggcgacagcgagcatattttagccattggtagaactgcctgtaagtcttgctagacgtgtaatcaaagccaggttacgctaaacaacctcttttccgacaggccgaagttggctgcccttgatcttaactggcagtcctatttttaacataatacgtactgacgtgagcattaagacgagtggtggtcttgatgttcgcgttttttagtttgttcacggtcgtgtttttcgatgcgtctgaaaaataggctattcagaaagtaagtaaaaccgaacataaaaacaattagcattaaaacagtcgcaatggcttgggcaatcatagttggacctcctcggataacgggtgataacactggaattatcagtgtcagtgactgttgtcattgtacgggcaatgcgaggcaaaatgcaagcggtggcttaaatgctaaccgtgaatcttgaaaatacggtatgataatagtaaccgattacatataggaggctaaattatggcatacatcgaagtgcagcaggcaacgcgccagtttaaaaatggtgagcaggtcaccgttgctaatcgtgatatttcatttgaagttgaccagggtgcggtcgttgtgattttaggcccgagtggtgcgggaaagtccacgttactcaatattttaggtggcatggacagtcctacgagcggccgtgtactggtggatggtgtggacattgcgcaattcaactcacggcaattaacaacctatcgccggcaagcggtcgggttcgtttttcaattctacaacctggttccgaacttgacggcgcgtgaaaacgtcgagttggcgtcgcaaattaccaaggacgcacgcgacgttgatgagacgttggccttggtaggactgacgcaccgggcagataactttccagcccagttgtccggtggtgaacaacagcgggtcgcaattgcgcgggcagttgcgaagaatcccaaattattactctgtgatgaacccactggtgcgctcgactatcagacggggaagcaagtcttacaggtgattcaagatgcagctaagcagacgcagacaacggtcatcattgtgacgcataatagtgcgattgcgcagctgggtgaccaagtcattcgtatcaatgatgctcaagtgcagtcggttgagcataatgctcatccaacgcctttggctgagattgaatggtaggtgcagcgatgacagcagcttattttagaacaattatgcgtgagatttggtcgtcgaaagcccgttttgcttcaatattactgatcattttcttaggggttgctttttatacgggaattcgggcgactggtccggatatgtcacaggcagctaatgattattatgcgaagcaaaagctggcgaccaatagtgtccagtcgacaatggggctgactaaggccgatatacgagtactgaatcaacaccgctcacagctcacttaccaagcgacacgctacgctgatgttaatcagttgaacaatagtcaagtcgtgcgggtgatggtgttaccgacaacccaacgactgaatcggttacggatcgttaagggacgattaccgcggcatgccaatgagatcgtgttagacgcgcaagcacagcgattgcagccgaagctaaaagtcggttcaacgtatcgaattagcagtacggctaagcgcaatgcacagttcacgcggcgaacattcaaggtcgtggggtttgtcaattcaccaacatatgttgaaaatacgaatcgtggcgtcaccaacgttggtaaagggactttggactacttggtctatgtccgtccgcaggtgattaagtccagtgtgataacgcgcattgacgtgcaattcaaaaatttgcggggcgtcaccccctacacggcgaagtatcggcgcttgaatcgcgagaacaccgcgcaactcaaacgctggttaaaaccacaagcgcgtaagcggcagcaggcattacaagcccaggcccaggctaagctgaaaccattgcaacaggcgacccagcaacttgctagtcaagtaccagcgggaacggcacaactagtcaagttacaaagccaattaaaacgcgcgcaggcccaggtcgcggccatcacaatgccgacttatttgtacactgaccgtacggataatccgggttacacagaatatcacgaaaatacgcaacgagtcgtggcactgtcgactgtctttccgctgttctttattgcgattgccgcgttaatttgtctaacgacgatgacgcggatggttgaagaattgcggctacagatggggacgttaaaggccctcgggtatacgaataccgcggtcggtagtgagtttatgatttatggtggtttagccgcgctgattgggaccgcgctaggcgtcctgttcggcgtcaattttttcccgcggtttatcgcgcaggcctatggtagtatgtataatttgcccgcaatcaactttcaatacatttggctggacattggtatcgccttagccattgcgttgttgtgcacgttggggacggcactggtcgtgctccgcgtggatttaaacagtttacccgcgcaactcttacagccacgagcacctaaggccggtaagactttgctattagaacgctggcaatggctatggcatcggctgagttttaatcataaaatcacacttcgtaatctatttcggtataagcaacggttgctgatgaccgtgctcggtattgcgggctgcatggcaatgatgattacggggtttggcttaaaggattccattggtgatattagcgtcaagcaatttaacgaattgtggcactacgatgcagtggtgacgcgtagtgggaacgaaacggaccaacaacggcaagcacttagtcgtggtcaactttaccaggctagtttgaaattacaggccaagcaggtgacggtcaaacagtccggggtagcagaacagacggctacgctcggtatcccggcaccccaccaatcgctaagcaagttcgtggtattacggcaccgacaaagtcatcaggccattcatattggtgatcgcggtgcggtcatcgatgaaaaattagctaagttatatggcgttcaggcgggcgatgatttaacaatcaagttggccgggcaaaccaccaggcgaattcacatcagtgcggtggctgaaaattacgtcaatcactttatctatatgagtccgacttattatcgacgtgtcttcaagcaggcaccagtatataacacgaactatgtccggtttaagcaggcaacgaaaaagcaagaaaatgcttatgcggatcggctattgaaacaggcgggggttcagaacgtgacactgatgagtacagagaaagccactaattttaaaatgctggatagcatgaacttagtcgtattgatctttgtcatctcggcgggggcactagcgctagtagtgctctataacttaacgaatattaatgtttctgaacggatccgggaattgtcgacaatcaaagtgttgggcttttacgatggtgaagtgacgatgtatattttccgtgaaaatctgatattgacggttttaggcattattgcaggttgtttcttgggcaactggttgcacgcatatatcttgcaaacggctgaaacgaacgcgttaatgttttcaccaacgattcatccgttgagttacgtttacgcggcattattgaccctggcctttagtttattagtcatgggaatgatgcatcgtaagttaaagcgagtcaatatgctggatgcactgaaatctgtcgattaaacgtgtctgacaacggccaacggtagccgaagtggtataattaaattgattggaacagtttaattaaggatgactaggggatgaatggcatggcagaaacggcacagttagaagctgctgtaaaggcattaagcgatattgtaaaaatgaatacggtaaataaccatgagcaattggtggcggattatttggtcacacttttaaagcaacatggtattgaagcacaatcaattgagtacgctcccgggcgggtgaacttggtggccgaaattggtgatggtcacggtccagtcgtcgcgttggatggtcatgaagatacggtggcgttgggtgatgcagataaatggcacacggacccgttggcagcaactatcaaagataatcgattgtatggtcgcggtgtgacggacatgaaggctggactaatggctgaagtcttcgcgatgattgcattgcacgatcaagacgtcccactccatggcacggtgcggttactcgcaactgtgggagaagaagtcgaccatttaggcgctgaacaattgacggaactcggttacgccgatgatattcaaacgttgatctgtgcggaaccaagcggtgcggacaaacaacttttactgaccaagtcgattcaagccatgttaggtgttgacggcgatacggcgcaacggatggcggatgcgaatccgacgaccgaacaacacttcatcgaattagcgcataagggttcactgacttatacgattaaagcgcaaggggtggcggcccacagttcgatgccagcgattggtcaaaacgccatcgatatgttgatgacttactatcagaaacaaaccgcctattttgacagtttcaagactatcgttaatcccgtattgggcccaaccgtacctgtcgtgacgttaattagtggtggcgaacaggtcaacaccgtcccagccagtgccgaaatgtcagtaaaaattcggacgattccagaattacggaatgaccgcttgattaagaatttggaagccatcattgctgaatgcaatgcggatggtgccaacttaacgatggacatcgcaagttcgttctacccagtgcatacgcgggaagatagccagttggtccagttggcgaagaaggttggggaacaagtcttacaacaacggctcccgtactttggtgctcctggtgggacggacgcatcgtcttatattgtaaagagtcctgatatgcaagtgattgtcttcggacccggcaatattacagcgcaccaagttaatgaatatgttgatttggatatgtatgggcgcttcatcgagatttatcaaaaaatgattacggaattgctggcttaacggaaacgttaataatcgtgaattaaattatgccggaaaaggtttcaaaaaaagtaatagtcatttcaagaattgattcttgaaatgactattacttttttgagcaaggcgactgaacctcggtgtatctaacttaataatgattgtggtgacggttgtgcgtcattcaggttattcgtgatgcccaaaccgttgcaagtaactcgaaaaatcttcgtgatcctgggtaataccagcttccttttcttcataccaattaattttgtcgttgagaatctgtagatgatgctgaacttcgttgaactggacgagaaagtcttctttaacgtgcttgagcagtgctaatcgctggggaatcgtgtcgtcgccggctgcgcgccaggtaacgtattgttgcaattcgctaatactcatacccgttcctttaagatgcaataagaatttgacccagttaatatcggcagtctcataatagcgccggccattgtctaagcgatgtggttcaatcaagcccgctttttcgtagtagcgtagtgtgggggcgctgagaccaacggctttagcgaagtcaccgattgaataacgttctgtagtagtccttaccaattttaaaattctccttattctaacttttatttgaagtaactttagcaataacaataccacgaaatcctattttagcaagttcaaactttattgttgacttaaagtgcactttaagttgtaagctgtattcatcaatcagttagcaagcaaataattaaggagtgtttttaatatgacaacaactaataatagcggcctatttggattaggtgtaaagaatgaggcctaccaacaatactttatcggtcaaagttacctgaatgccttagccggtgatgagcaggtcgacgtgaatgtttccaacgtgacgtttgaacctggctgtcggaataattggcatatccatcataacggataccaaatcttattggtaacgagtggtgaaggttggtatcaagaggctggtaaaccagcccagttattgcatcccggcgacgtggtcacaattcatcctggtgtgaagcattggcatggtgcaacaaaggatagttggtttgcccacatcgcgattactaagggaactagcgaatggctcgaaccagttgatgatgaagcctacgcaaaattataaaagttaaagtagttatcgaaggaggaaactaatatgacagttaaacaaaccgcaggacgcgacaacttaggcaaattagcaccacagtttgccgcattaaatgatgatgtgttatttggtgaagtctgggcacgcgaaagcgcactaagtttacatgatcggagcatgattacgattgcgtgcttaatgaccagtggtgattttccacaattaaaggcgcattttaagatgggcaagaatcatggtatctcaaaggatgaagccgttgaaatcgttacccacttggctttctatgcgggatggcctaaggcgtggtcagcaatggcactgattaaagaagtttacggtgaataggaggaatagttagatgacagttaaaaacaaagtcgttgtgattacgggggcctcgtccggaattggggcgacgaccgctaagcaattagccagtaatggtgctaaagtcgtgttgggcgcacggcgtgaagaacgcctggccgctttagttgatgaaatcaaggcagccggtggacaagcggcctatcaggtgacggatgtaacgaagtcagccgatgtacaatcactagttaagctagcgcaaacgcaattcggtgggcttgacgtgattttcaataatgccgggattatgccgacatcaccaatcagtgctttgcacacggatgaatgggaccagatgattgatattaacatcaaaggcgtcttgaacggggtggcagcggtcatgccaatctttaccgctcaaaaatctggtcagattattacgacatcttcagtggctgggattaagtcctttgctggctccggcgtgtacggtgctacgaagtttgcggttcgtaatttgatggaagtcattcggatggaaagtgcccaagaaggtactaatattcgaacggtcagcttatatccagcggccatcaatacggaattactgcacacgattacggataagacggccaaacagaatatgactgatttttatcaacaagtgggaatcagtccagcagccgttgcaaacgtggtcaactttgccattgaccaaccagaagatgttaacgttaatgaatttacgatttatccgacgaagcaggcttaacttgatttagctgttgttaacggttgtttgagctagttgccgataagtcgaaaatgtgaattcaaaaaatacaagcacccggtctagcgcataatggcgttgctagaccgggtgcttgctgttgttatattgtattaataatatttaattagtgggcctacttcaaccgtaagccacgctttaagttgccccagaaaccgagttcatccgtttgtaacattagcccaccatagattcggccgatgtagatcatacttccaatgattgttgcaatgagaatcaggagtgacacgattgcagcgggcatcgttgccatgccgttaatgaggcgtaatggcatgaagtatgatgagaagaacggaatatatgagaaaatcttaacgaagagattggtgggtgtgttctgaaaggctagggccatgaaaaacgctagcatactcagatagatgaccggttgtgctgccttgctagcatccgcgacccgggtcaccaaagcaccacagaaggccgacgctacggtgtagagtagtacggccagtaatgcaaacaacaagttgattgagaccaagttgtgaattacttgattgatcagatcggtattctgttgccaaaaatcaattgtgagtgagctacgtttaacgaattgcatgacggcaaagccacccactaagtagacgagcagctgagtcacaatgactagtaagacaccgtaaattttaccattgaagtatttccgcggtgtcgtactcgagaagatgacttccataatcttggtgcctttgtctgcggcaatttcttgggctgtgattgctgaataagtggtcaaaatcaagtagacaaagaagacgacaatatagaaggagaccgttttagctgttttatctgaagcagcgtgcttctgtaattgttcagtaaattttggctgtacagccaacgcctgggtctgcttggcacttagttgtgcgcgctgtacgttacgttggctttgggcagtggctaagaactgctgaatcttagccttgtcaccgctgctgacagcattaggaccagtgaactgcgcttgcaactgttgattcttggttgttaaaacgaggtagccggcgatgtcattgcgcttcgtcgccgccttagcgctggcgagtgtttggtatttattagcggtagccacatgactctgcttaatgaaacttgtgcgtaattgtgggctagtgctaacgaccgcgatgtcattcttactagcgctgggtgcagcaaaataagaaaaggcggccacgagcccgaagaacaagaagggcataaagacgagtgacaaaaagctccaggacttgatctgccgcaagtaggtttcaaaagtcacaatccaagtcttattcatggttaacacctcccgcttcagttcggaaaatctcatccagcgttggtggctgctgactgaactcttcaatgtaataaccagcagtgacttgatcaaaaatcgctgggccaactgaagcatctgcaagttcgagtcggaatcgacgggcaccttgttgagtaacggtggtgactcctggtagatcggccagttgcgcttgtgaccagtcagtcgtcaagaagagacgggtccggccaaactgggcgcgaacatcttcaacggtacccttaaggactgcttcaccattacgtagcataacgagtgagtcacagatcgcttcgacattactcatatcatgactggaaaaaataatcgcggcaccccgttgcttagcatctaaaatagcttgcttgagcaggtcggcgttgaccgggtccaaaccactgaatggttcgtccaagataatcagtttgggatcatgaattaaagtacaaatcagctggaccttttgttggtttcctttagataacttatcaatcttatcggtcggctgccccttgaccgcaaagcgcttcatccatgagtcaatttttcccttggtcacccgtgccggctgatttttcaaacgggccaagtacacgatttgttgtgtgatggttaatttggacattaggctacgttcttcgggtaaatagccgatttgatcgtagtcatcagcggtcaacggttgcccattccaagtaatttgaccgtcgaatgatagaaaatttaagatgctgtgaaatgtggttgatttccccgcgccattttgaccaatcaatcccatgatttccccgtcatggacgtcaaatgacacgtcatttaatgcttgaacagtcccgaaacgcttctgaatatgtgcgatggatagcatgagtttgtcccccccaattcttgaaataaagtcattacgtgttgtgcgagctaattagtcatgaaataggattaaaacgtgccaagtttagattattattcgtcagcaatgatcgtcctattccgacctccggggctgggtgacaattgctggaacgtaagccgacgtcgatttgagctaacgcccaacccgcgtcatctcaaatacgagtcttattctaagccggaagcaacccacttccagctaagaataatttggctactgagcattgtcacccagcccctccagtcgggaatccgctcgaatggctgatgaacggccacttaacttggtgaaatttgtcgttggctattttgatacgggaactttaaataaaacatcagggtgcataacctactttgtcgcaacattcaattttgactacagcggcttaagatgttgagctattccaatatcattttcagtctggtagttgctgagagaaattactgtttatgaaaaacaatgacgaattcaccaaaagttgggtccgcacatgtccgctattcgaacactgtcccgactggaaggcatttcggccaatgctcagcggtgaaattccacttagcaagcatccttggcttggttagtggaagaccagtatttaagacgtggtcttcggcttaaatctgtgtccaccgcgttccagcaattggcagaaatgcctggaagtcggcgtaggacgcgccaactaagcaattttatgctaatgcgaactttttccagcgggcctaagctggctgcttttgaacttacacaacttggcacgttttaatcctaattaggcctaataactattggcacaattagcaatcattgtttgattttatgatgacatagttgattcggtgtgacaagggcgtgcgcttggttctaagtgaagcttatttgggcaagcgggcgttttcaagagctaatagggcgcgtttcattggcaaaccaccacgatagccgccaagttgaccgtctttgcggcggatacgatggcaggggatcacaataaggagtggatttttaccaacggcgctggcgacggctcggactgcggtagggtgattgatcattgtggcgagttgtgaataagttgcagtttgaccgtatggaatacgggttaaagcttgccaaacttgttgttgtaaaggggtacccgtcgtttggtcgaggggtatgtcaaaatgctggcgttgaccagttaggtaatcatgtaattcttgacaggcctgttgattagcttgttgatcataatgaatattagcggatttgaagaaggcttgccattcgtcgcgtggaccgttggcacggccgacaaaggctaagccggtgggcgttgtgcccagccagtaagtttgctggttaatggttgtttgggtcaatgttaagtgcatgtgtgagccctccgtctcaattaggatagcgttagtataacagaattggtggtgtgacgacctgattaaatcagaacatcactgctatatcttaatgaaaaaagccagtgcgaacgatgagtcgtccgcgctggctttgatgtcaataataaagcttgaatttgataattgcagatgctgattagtaccagccgtttgcttgccagaacgctttagcagcagtccatgagccgtaacggccagcgacgtatgcgtcggcagtcgcttcttggttggcggcagaataatcgccatttaagagggattgaccaagttgatatttaccatagtaaataccgttggttacggtgtaggagccaccagattcgcgagcagcaatccaggccttggcagcagcctcagatgtactagtcgagctggttgtcgtgtttgttgttgaactggccgtgcttgagctagcttgactggcagttgtgctgctagtacttgcactactagttgcggctgaactagcggtggtcgtcgtgctttgactggttaccgttgtactttgactagccgcactttttactgaactagcactggcttgactagtgctgctttggctagcggccgacgttgcactctggctcgtcgtactagtgactgaactagcactggcttgactagtactgctttggctagtggccgacgttgcactctggctcgtcgtactagtgactgaactagcactagcttgactagtactgctttggctaacggccgacgtcacgctttggctcgttgcactggtaactgagctgccgctgttttgactcgtgctgctctggctaacggctgatgtgctgctttgactggctgcactggtaactgagctggcactggcttgactcgctgtgctttgactaaccgttgacgtggcggtaacggtgctagtaggactttgaacggcggcactagttgttgtagtcgtcgtacttggtgtggctactgaagtggtggcccgtgtcattttaactgtctggtgtttgttaacttgtagtttgtccccgacgtagattaagttgacgttcttcaaatggttcaacttttgaacggcggcaacggttgttttgtgagtgtctgcgatttcactgacagtgtcaccagccttgaccgtcaccgtatcggccttagcagcagttgcaccaagggcaatggcaccagttgttgctaatgaggataataataggtgtttaattttcatataattgattcactcccaaactagattagacttcccttaaattttaccatcatgtaagcggttcgttaagcgcaatttgcttactgacggactttttagaaaataaaacatgcccgattaagacatagtgtaacagattaacgcttacattaccgctaatttgcaatgcaatcttagtgacgagtgtgtcaatgtagtgacctgcgtaacgtgattacgttgacggtggggggcatggtagaattggacttttgaaaagccctcccaaattgactgcggcttgcacgtgttcgactttaccagcagactatttgcatagtggttgatgaaggactgcaataagggccgataatggggggattgccagtttgcagtcaggcaagtccgatgcacctatatggcaacagaaaaacgtggcccccatataggaccgcgctgattgtatgttcagttgtgcatgaatgtgtttagtaataaccgttggcttcccagaaggccttggccgctacccatgaaccgtagcgtgaagccacgtattcgtcagcgacggtttcctgattagaagctgagtagtcaccgtttagaagtgacttgctgagttgatacttaccataatagttcccgttagatgcggtataggagccaccggattccttgttggcaatccaggcttttgcggcagcttcagcactacttgatgtgctagttgttgatgaactgctgctagtactcgttgtggtgctgcttgaagtggtagcactactgctggctgccgtacttgtgctggcggcactggaagcagtggtgttgctcaacttcgtcatagatgcggaagtggcggttgaacttgacgccgtgctagcttggctcgttgcagagcttgaagtggcactgctagttgacgaactggcggcactacttgaggccgcgctggcggttgacgtgctggtcacgctacttgaagcagcacttgtgcttgatgagctggcagcactacttgaggcgacacttgtcgttgacgaactggtagccgtgctagctgctgacgtacttgtactgctgctaacggatgcgctgctggcactttgggtgctagtactgttggccgttgaactggcagtactggtcgaactagccgtacttgaagcagcactagttggtacttgggtagtaaccgtggttgcgtggtgtttgccgttgacttccagtttgtcaccgatatagatcaagttaacgttctttaaatggttggctttttgaatcgctttgatggtcgtcttatgcgttaaagcaatttcactgacagtatcgccagctttaacgacaacggtatcggcattagcaacggtagtacctaaagctaacagaccggtagctgccaatgaagttaatagggcatttttaattttcataagttaatcagtcactcctataaaagttgtgttgttatttcgattgaatggtgattagtataccgaccgcagattgcaaagcaataaataacagattacggtttgagccaattttgtaataaagtaacatggtgtaacaagttaacactttcatcatgttttcgccacattatcatcacactcgcggtaaaattcagaaggtaacttaaaaaatggtttaaagctgtgagcgatattcttattaattcagtaaaatttgttataatcgagaccgttaagcagaacgtcgtgtaagggagcgagtaataatgtattattttgtgaataccagcattaacccgaaaaaatcgggaattgaacatgctgagatgaaacggctggcactttttaaccagcatcacgttcctgctaagatggtcacgcgatttttttcattatcgttacaccagacactgacagcagcagggattgcggctgaaaatcaaattaatctgtttgatttcattcagcattccagtgaacggccaacgactaagatgacgattgaagatctgcatctagcaccggacttgcgggtgcaatccgttgggcgtcattatgaagtttatcaaaatgaccaattattaatgaaggtcaatacatttctgaacactcaaaaacaactgaacaatgtccaatattatgatcaaaatggtaagttagtgaagaccgattggtacgatacccggggatttaaagggcttgaacagttctatgccgctgatggacaagtagcaagtgaacaagtctttaatccggacggggaggttgtctatcagacatttcatatggcagatcgacaaaatcaggtccaaaattcactttatcgattcattaattatgaggggcaagactggtcatttgctggtgaaacggcaatgacaacctttttcctcgatgaacttaatcggaggacgccgcatgcggtctttgtcattgatcggacgtatgagttggcttacgccgcacttcacatgcgaactaaagcgtttaaagtcatgcatttacacagtaatcacgttaatgatccagcccatccgaagacggctagtctcaactttaattatgcttacgcgctcaataacctagaccaatggaacggcgtcattgcgtcgactaagcaacaaactgctgactttcaagcccgctttggcaatcaacccgccgtttatacgattccagttgggattgtcgatgacgcgactttgaatgcgcccaagccatcttttgatcagcgcaccgcaggcaagattatttttgtggcgcgtttagccgaagaaaagcaacaagatcaggtgatccgggcattcaaaaaggtattggcccaagtgccgaatgcgacccttgatttctggggctatgcaaatggtgataccggcaaacaactgcatcaacttgtggaacagctgggactgaaagcggcagttacgtttaatgattatacgaccgatttaacagctgtctataatgatgcgcagttggcgatgttaacgtcgcgggcagaaggttttgcacttgccttgcttgaaggtcaggcccatggggtgccccagattgcctatgatgtcaaatatgggccacgtgatattattcgggacggtcacgatggtcaattggtgccggtcaatgatgaaaatgcgttggctacggcgatgatcgacttgttaacgcagccgaaaaagttagccatgtatagtcaacaggcttatcaagatgcccaacgctttagcacaacggctgtttggcaacagtggcaaccactcatgaaagccgcagccgatttttatcaagttgagggggcaacacagcgatgaatttttttgtgaaccaatatttaatggcgttaaattctggtgtggaacatgccgaattcaaacggctccagttgtttaaagatcatcaggcaccggctaaactagtaacgcgtcaatttgatggtttgttacatcagaatatgcggcgcttcaatattgccgatgatcagatggccaacttgtttgacttttttcgtgaaacgaccagcttttccagtcgggtcatcaagatggctgatttgaactggccaactgcctatgacattaagccggaccccaatgtcagtgaggtgcgagctggtgatcggctggttgctaaggtccactttgtccccagcacggtggggcatgtgtacttcattgaaatttttgatcacttcaataatcttgttcagcgtactgattatgatgaacggggctttaaggcccgtgatgaattcttctcgtcagccggggaaccaatcacggatattttctatcgaccagatggtagtcggatggccgaacagtattatacgcatgataataatgggactaattatgtttcgttgtgccatcttatcaattatcatggccgtgactactactttaatggtgaacaagaatggtaccggttcttcttagatgaactgaacaagcaatatgatgaaaacaacgtctttattgcggatcggccgttagctgctcagtggccggtggtgaacatgcagacggcggctaaaaaatatttgtggttacccacgccacatgcagtcgatccgcgtgatcaagtctattctaatttgaataacgcgtatgtttatggcctgcacgagtttctgagtgcttgggacggtgtgattacgagtaccgaacaacagaagcaagatttgacgcagtggctcggtggtcaaccgagtgtcccaatcctgacgatttcagcagccattgtttccaaacagcaagctcaacacgcaccaatttcgatcagtgaacgtcatgcgcatgaaattatttataccggccgtttggatgcggaacggcgcgtcgatcagctagtgacagcttttgaccaagtgcaccataagattacggatgcgaccttagtgatttacgggtatggtggtgagcttgaccgtctaaaacagcaagtgtcccagttgcacctagagaccgccgtgacttttgctgggtatcaaccgaacttaacaatggcttatgatcaggccggtgcttacgtttatactggtgaaagtgatgcgcagccattatcgttaattgaagcccttagtcatggtgtgccagcaattgcttatgatattaactatggccctaaggatgttttgaaggatggcaagaatggttatctggtcacggatggtgccgtcaaccaactagtcagagcgctgacccgaacacttgaaagtccgcaacgtcagcaacgacttagcaagggggcctatcggagtagtgaacaatatagtgatgaacaagtttggcaacagtggcagccggttgttcagtgaatatcaaaaatggtctgactttagtggtcagaccattttttaaacgctaatgtcaaaaagacctaataacaacggcggggatcgctaatctgaccacgttgttaggtactgggtaattgcagtctgtacggggcgcagtgccgctgccggttgcgtgttagtcagtaaaaagaattggcgttggtaatgggcacttagctgttcgatgggaatctcgttgcttaaaacgtgacgtgaaataattgtttggccgataccatgagcgaggaggtccgcgatgatttggttactgtggatgaccatgacttgtgctggctgaatgttgcgggcttttaaaaaggcgttggtataatgacgcacaccggaattaggttcacgtagcagccagaggggactggcaaagtcgcccgcatggacgagctcatcgtgaccaaatggcaagcgattgagctggtcagtaacgagtggcttttcaactaaaccaaagtccagtttgtgttgggacatagcggtcaaaatttcggccgaattggcaagcgtcacttgaaagtcaaagcgatcactgacggcactcaaattggctaataaggtgggtagaatcagacgcccggttgtgtgtgaggcaccaatccggcaaggaactttcactaagtggcgtggtgattgtaccgctgttttggtagcggcccaagttgttaacagcttttgagcctgttgatagaggagctgaccactggcagtaggaacgatttcttggcgcccgttacgtgttaagagcgtggtttgtaaatcggcttcaagttgtttgatttgtgttgagacggtcggctgggaaataaaaagttgctcggcggcatgggagaagttgcgagtttcgtataccgcacagaacgtttccaattgtttaaacattgtgttcacccctaactattatttttattaatagtaactatcataataatttatttctcaaatgtaaataactttcgtatacttaaaagcatcgagatagagatgggagaaagcgaatgaaggtcaaagggattttaccggggttagtgaccagtctggtcattgcaattattagtcaaggattggcgcaatttgtgccagcgttaggtgcggctactatcgcgattctattaggaatcattggtggcaatacgtttctgaaacaaccgcaacttggtcgggggactaagttcgcagaaagtaagctgttggaatattccgtgatgttgctcggtgcgacgatgacggtacagacaatcggcaaaattggtgggttcggcgtgctctttattctttgccaaatgacgattacgatcgttggggctttgtggttagggcgtaagctgggtttcagccagtcggtacgtatgctgatggccggcggtaacgccgtgtgtgggtcgtcggcgattgcatcaatcgcccccgttattgacgcggatgaagatgataaggggactgtcattaccttagttaacttgatggggacagtgctgatgttaacgttaccggtcttaggaatggccgtgtttggtggcagtgtcattcttaaaggggcgttgattgggggaactttacaatcagttgggcaggtagtggccgcagctagtatgattaatcaaacaacggttcaatttgcaacgattttcaaaattatgcggattatgatgctagtcgtcgttgttttgatttttggccggttacaccaacgcacgattgaaaatgaattggctgaggatgctgtcgtcagtggtaatgggaacggtcattggttaccatggtacgtggccgggttcttaatcttatgtgcattgaatagcttgatttcgttaccagcaattattggcgcaacggctcatacaatcagtagttggtttgaaatcattgcgttagcagctatcgggttacgtttgaatcttgttaactttatgaaagctggcaagcgcttagcactgtatggtttaggcgtggggacgattcaggtcgtcagcgccttgattttaattacgttattactgcaacattaattgggttttgagacacttaaatcgcaatcatggttaatcattcaattaatcatgattgcgatttttcatctaagagagtaggaatgttcatgctaacttatcgagtcacaccagcgattgaattgcgagaaccgctaccccaaagcgatgcgccggcattactagcattattaaccgctgatcgtgcgcagtatcagtattatttgccatgggtggctaaaattcaaacggtggcggatgaacaacgctttttaacttttgcacaagctcagttacaacaagcgcaagcgctcaacctagtcattgtcgttgaacaacgggttgcgggaatggttagctgtgaccacttcgatgataacgaccacagtgccaacatcggctattggttgggacgaccatttcagggacgcggcgtcatgacggcagccgtccgtggcgtttgtgatttgggttttaatcagtatcatcggcaatgtttgcggattcgtgcggcggtggacaatcaggcaagcaatgcggtggcgcaacgggcgggctttgactttttgattcagcatccaggtggtcagcacttattggatggcgatcatgatgagaatgtgtatcaggtttcagcggttgattggctggcgaagcgccacaagtgatgacgattaaacaaaaataaaactgactagccaagatggttagtcagttttattaacgtctaatttttaactgtcaccacttgccacgtcttaggaattgtaaacaaatattggcgttgaacaatttttgtcttggtatttcctaggctgaataacacgtgtgtcaggtgatttttaaactgccaagtcgtggtctttagttgaacctgcgcgggtgaaccgctagtcagtttagttgttgtggtggttgcggtcaccgtgtgactgactttagtggcggctgcaactcggtaactgatgacgcgttcagaccccgttccgagttgctggacccgcaacgccgcttgtttggattttagcggggctaaatcttgaatttgcgtgcgggtgacttcgtgcatgccccaatggtaattgtcgtttaggacgagggcgatgaggctagcggcaataatcagggcactaataataatggcaatgagacggttgcggcctgctggtgaaaaaatcatcgtgccagcaaagacaagggttgcaagaattagtaagacaatgatcatgcggcatcatcctcctgactaatggtttttgaatgattggcttttaagaagaaggtaatcccaaagccaatcgcacaaaaaatgagtgagacaacgaacgccatgtgataaccagttaaggttgcggtgattccgtcctgacggtatttcaaaggtgcctgtgtcagtaattgatgtcccggcatttgccacttagcgacgctggagtagacactgattaaaacggccgtccccattgaagctgcgacttgacgtagggtgttgttggcggcggtcccatgggaaatcagccggaaaggtaacgcattgatcccggtcgttgtgacgggcatggtaaccatggtcaggccaaacatccgaatggcgtaaacaacgatgatccataagattggggtcgtggcgctaattgataggaagaaagcagttccaagcgttaggagtaacatccccgtcattgctagtctgcgggcaccgatatggtcaaagatgcgaccagtaatggggctcataattcccatcatgattgcgccaggtaataaaatcaatccagagtccattgctgaacgaccgaggaccgtttgaatatacattggcaaaatcatttcgacgcccatcatagccatgtaagcgagggcggtcaggattgcggatagggtgaaagccggaatcttaaagacacgtaattccaataatggctgatccatgtgaagttgccgccagacgaatagaccaatgaaaatcagaccaatgactaaagttgtgaggacgactgggtcgccccaaccagcattaccaacggatgaaaaaccgtataacatactgccaaaaccaattgttgagatcaagactgaccaccaatcaattggttgtttggaagttggtaagactttccgtaaagtgaagaatgaaacgatgatgactagaatattgattggcaggatgaataagaagagtgcccgccaggaatagttatcaataatccagccagagagtgtcggtccgatggcgggtgctaagccaataacaattccggctgtccccattgcggaaccccgtttttcgggtggataaactgaagacatgattgtttgaaacactggggcggaaattccgacgcccattgcttgaatcattcgggcaatcagcaacatctgaaagttgacggcaaagtacgccagcgtagttcccagaccaaaaataagcatggctgttaagtacaaatacttggaattgattcgggtcagcaaccaggcactgacgggaatcatgattcccatgattaacatgaaaccagtggtcaaccactgaacggcggttgctgaaatatgaaaatcggccattaacgttggaaaagctgtcgttaatagtgtttgggtaatgaaggtagtgaacgtcccgacaagtaaagtcaatacaagccaagtccggtgatagggctggccgttggcatcaagcggcaacgttgaattttgagttggcataataccgtcctttcttttataaattctgtaataatgcacaatcaataagtatatcacgatgcaagtcctaggcctattaattggtactggggcggtctgctgagtgttcggtgtcgtggtaaaataaaatagataatattagttaatttgtggtgagtcgtgctaatgatagccagcacaattcatcgacattcagtaaggaagctaaaaaatatgaccaaaaaatatttaacatttgattgttacgggacgttaattaatactgagccgctgtatcaatgggtggctaatttaggattggcggttggtttagacccactgacggttcgcaaagcctacgcgacttatgaggacgatcctgccagtgtcaatccttatctagattattcaacattagtccgggctgatcttaagcatttagatcgattgtttgaacagagacacttctttgaaagtcattacgttgaatgcttggaagtgcaacgacacttattaccatacgccgatgttataccgaccttaacagcgtggcagcaattgggctatcaattgattattatgtcgaattcttcctgggatattatgccggccaacattgctgctttaaaggtgccgttcacagcggttgttacggctgaagacgttcaagcttacaaaccagcgttagctttctttgaaacggttcaagagcgttttaagttaacggcagataatcattggcatattgcacgtggctatgaatccgatgttgttccagccagtgctatgcagtggccgatgatttggattaatcgtgatcagcgacaaccgactagttctgaacggccgacccatatggttactgatttggccgctgctaagcagtgggttaactaggcgtgcgcggtagtgtccccgttgatcaacagttaaaacactggttgatcatcagggctgaacaagctttctaattttgactaagctgttaaatctcaaaattggaaaggaaattaacgtgaattcaaaatctttaaataaaagtacggtcctattaatggcgatctccgcggccattgtagtggctaatattaattatattcaaccgattgaggcggacattgcgcaacagtttaatctcccaaacgccgttattggcgcggtggcaatgctgacgcagttaggctatgccttcgggttgctcttaattgtacccatgggtgatatcatgaatcgccgaatgttgattatgcgcttactggtactcgcaatcatttcagcgttactagccttcgtggctcccaatatttgggtgtatgccttggcaagcttactgattgggataacctcggtggcaccacaagttattattccgtacgccggctttctcgcacctcgtaatcagcgtggtcaagtcttgggcaacgtcctgagtggcttgctcgtgggggttctcttgtcacgaactatcagtggggtacttgcgagctatttgccttggcagatggtctatctgattgccgctatcttgattgcaggattgtggctcgtcttgtggcgaaaattaccgcatgatcccgtgacgacacataccacgaattataaagccatgattcagacagtacctcagttagtaaaacgctatccggttttgcgagcgtcggctgttaacggatttgtcttgtttggtgtttctaatattttctgggcaacactcgtcttttacttgcaacatcaatacgggtggggaagtcgtgaagctggtctgcttgcgttgctaggtgttaccggtgtgttagcagcccctttaattggccgcctagctgatcgttttcggccccgaacgattatcggcttgggtctagtgttatcaacattagcctacgtcgtgttttggctgagtggtacgcatttggtggggttaattattggtatcgtcattcttgatttaggtactcaattcgggcaggtcgcgaatcagacacggattcaaagcatcgatgtccatgccagtagccgtttcaattcggtattcatgtttggctacttcatgggtggcgccctaggttcattctgtggcaacgtcttatgggatttagctggttggaacggcgtctgcgggttagcggtcgtcgtgttaatgattggcttttatgcccactttgttcattatccacgggtggtgacacgacaagtgcaacattagcagtgtattagttaatcggtcatgaatcatgattaaaacgtgtcaagtttagattgttgttcgtcagccggtgtgcgtcctattccgacctccggggctgggtgacaattgctggaacgcagccgacgtcgatttgagctaacgcataacccgcgtcatctcaaatacgagtcttattctaagccggaagaaaatcacttccgactaagaataatttggctactgagcattgtcacccagcccctccagtctcagcctgtgaggggccacgggttgaagccgagcattgcctagccatcggattaatgcggttttggcattagtccgttggcgtagcaagcacaggattcagtggcaccgagcacgtttcgggaacccgctcgaatggctaatgaacggccacttaacttagcacaatctgttgttggctattttgatacgggaactttaaacgaaacgttagggttgtattaaccactttgtcgagacggccaattattacgatgttgattgaggaatagtgagacatcctaatatcattttcaccctgacagttgattgataaaattattgtttatgaaaaacaatgacgaattcaccaaaagttgggtccacacatgtccgccattcgaacactgtcccgactggaaggcgtttcggccaatactcagcactgcaagagtgtgaggttcagacgagttgagactgaggattagcctagctagggcgttaagcggtgaatttccgcttggcgtcatagcgtagctaaccgcaagtctcagtctgacccgaacacgtttcaccaatatggcattaaagcgtggaagaccagtatttaagacgtgggcttcggcttaaatctgtgtccaccgcgttctagcaattggccgaaatgcctggaagtcggcgtaggacgaacttgaaaagcatgtttacgcccactcgcacctgtttccagcggtttttagctggccgtttttgaacttaaaaaacgacacgttttaatcatgattaatcctaaaatgactagcacgatacctgttgttaagtaggctgttgatgtttgtgtaataacttaatgattggtataggcgctggcagtaggggacagttaattaatatgaagtatgctgatgatgagcttaatgaatattaaccataattggcgttgaacttaatattagtcgtaaatcaattaaaaggattgtatttcagagaaaatggtctaaactctaattattcatgttagaagatgtaacatgaaatctaaataagagggttttgctatgcgaattgaagctgattgtattggtaagttagctgttccggatgatgctttgtatggaattcatacgttacgtgccgttcataattttccgattacgacggaattgatgcatccactgatcatgcaaagtcttgttcaaatcaagaaagcggcggccagtgtgaatgcggctgccggaactttgtctaatgataaggcacacgccattattgcggcatgtaatcagttactactggggcgttacgcggataacttcattgtgccagcgattcaggggggtgctgggacctcggctaacatgaacgtcaatgaagtggtggctaatttggctcaccgattgatgccggcagttgccgttcatcccaacgatgatgttaatcaatcacaatcaaccaatgatacttttccaacggccggtaaaatggcgctttgcatgcaactcccaggactattaacggcactcagccggttggtacaaacgttactggttaaatcgcagcgttatcaagatgccatcaaagttggccgaactcagcttgaagatgcggtaccgacgacgtacgggcggacctttcatgcttattaccaattatttaagcgtgatttgactcgtgtacggcaggcgggcgaacatctccgaatcgtaaatttgggtgggactgcaatcggtaccggcatcaacgcgactcacacgtatcaacagcagattttagtgaaattaaatcaaaatactgatttagatttagtagccgcaccagacttgatcgatgcaacgcaaaactgcgatttgttcgtggaattctctgcggccatgaagacgttagccgttgacctttccaagtttagcaatgacttaagattgctggcgagcggcccacaagctggctttggtgaattgaatttgcccgcgcagcaagcaggctcttctattatgccaggtaaaatcaatccggttattccggaggttgttaaccaagttgcgtttgaagtgattggtcacgacacgacggtaacaatggcagcggaagcgggccaattggaattaaacgcttttgagccaattatgttacgggcattgctagccagtgagcagcatttacagcaggccttgacgacattagtcgatcactgtgtgcggcaattgacggtcaatcgccaacgctgtgcagatcaagtggcacattcggccattacggcaactgttttggcgccatatcttggttacgagacgactaccgcgctgattaaagaagcgctcaccactaaccaagcaattcctgaattattacatcgacgtcgcttgcttagcgatgctttggtcgagcagctgttttcaccggccggactaactcagccacgcccagaggttattgaacaactacgagcggttgcaaagtagccactgttttgcagtgcaatttatggctgagataggctagtgctgaaggttgacaccagccagtttaaagccaatggacgtcgcacgacttagcacaaactaaagttagcgcgctttctgccaattactaaaacgcagtggatccaagtttaagccgtatctcaaatgctagtcattaaaaatgagtcaccagaatgaaagattctgatggctcatttttagttgtcgtttacttagtcttagctaaaagcagtgagacacattagtgtaagttgaccaaagcaaaaacgattggaatggtaacgacacttaaaatcgttgagatgctcattagggcaacggctggcccgggatcaccgtggactttgagtgagaacaagacgacgattccggcgactgggcaagcggccattaacactgtggtgaataatgggatgccagtgatacccattagctggaggacaacaatcgccaagtatggaaacaataaattgcgcaataagatgactaaccaaagacgtttatcgagtgttgcacggttaagtttaacgtctgccaaactattcccaataacgatcatggacaggggtgtgttgaccgaactgacatatttaatagcgctattggcaatcgttggcagttgcagagaggttacgaagatcagtagcccaacaacaatggcgatgatattcggattaaagacgatctgtttaagattatcccgccgattgccctgttgtccggtgaagagggtgatgccgtgagtccagctaaaaatattgaaggccgctaacgaggcaacagcatagaatacgccagttgcaccgaatagggagctggttaatggaatccccataaaaccggcattagagtatacggcaccgtaacgcataatgcgacgcaaattctggtcagagacacgtttgaatagtaattgcgtcacaataatcatgagcacataaatgatcactattccagcaatgacccgggctaacatttgtaagcggtcggctgaaaatgtcttttcaaaggcttgaataatcaagcaaggtgacacaatgtataacaggatgttggttaaatcagttgaagtctgggcatgcatgaagccgagcttgttaacgagcaggccgacgagcatgagaatgaacatcaaaatgatttgactagttagttgcgttaaattcatttacttcagtccaataaattagaatactctcattattgaggtttggcctgaactttgtcaagattcatttaggccggatgatgcgcctggacaatatccacgtgatgtttgagatggggaaaaacatgatgatcagaccaccccatgatggcaccttgagcaattaaggcaaaggccgtcccgaagccaatggcgcgcaaatgacctgtggcgaagaatgaaacgacgataatcgtcagaggtggcaaataactagtccactgggcaataatagcggaaccatgtaaaaaccgaaagcgtaagatatacgataaatcatcgttcggatgctgaattaaattacaacgctggtaaatcgagacggcggccgcaacgcctaatagcccaagcacgtttagaatcaagcgtggtaacaggggcagggcgggaatctgtagccaatcccaaaagtagccgataaattggaccaggtaactaaagggcacgatatagagcaagttggaaataaaccgacgccgatcaaagtgacctaacagaagttggttgagaatcgtgacaaccacaccgtacagtaataaggtggttcctaatgaaatatgggtccagtcagctagattaacgctggagccagtccagacggcgctgcctaggctggtggcgatggtgagcgcgttggcagcagaattcagaataatggaaaagactaaaaaaccaaaacgttgacgaaaatcaggaatgttcaacacgactaagcgacctttcagttaacagtatatgagttattataaccgctttcataagtagatgtcacggctagactcataaaaatatgctatactaattgcacaatagattttacggttgaaggacacttcaagaattcggactacttttgggttgggtagtcagagcttgcagtgcccttttttaggaggtttttaatggattacgttggtagtttagcgttgattttaattgttacggcggttgcgggtcacctgagtgtccgaatgggcctacccgcggtgattggccaattgttaagtggaattatacttggtccagccgtattaggttgggtctcagcaacaagttttatcaaagacttcgcggagcttggcgtgattattttaatgttcatggccggcttagagagcgatttgaaattgctgaagaagtattggcgtcctagtttgttagttgcggtcctgggggtcattctacccgttgcggtgattgactggtgtagccaactatttcaccttaacgccactgaaagtttgttcttgggcgtaaccttcgcggccacatcggtttcgatttcagtcgcggttctcaaagagttaggcgctctcgatggtaaagaaggaacgacgattttaggtgcagcggtcgttgatgacgtcctggctgttttgattctgagtttgatgatcagcttatttggcagtgaagtcagtggtggcggtagtcatgcctcaaccaacttgggactctcgctggcgattcagttggcgttctttgtggcgctgtactttgtggtcaagtgggtggtgccacatttaatggccgtggggaatgccctactggttccaacctccatcacgctgatgtcactagtgatttgttttggactctcatacttagcggacgcaatcggtttaagtgctgtgattggcgcgttctttgccggtatcgccgttggtcagacggactatcatgaagttatcgatgagcatattcaacccattggtaatgctgtatttatcccagtctttttcgttagtattgggttgaatatgtcattcaatggtttcctgaacgatttttggttcattgttgtgattaccgtcgcggcaattgccactaagctcattggtgccgggatcggcgcacggttggcgggttttaattggttaagcggctatgagattggcgccggcatggtgtcacgtggggaaatggccctgatcattgcacagattggttatcaaggcaaattactatcagctgatcgttattcggcagtcatcacggcaatcattttaacgacgctgattgcaccactattacttcgtcaggcggttaaacgccagcgtgaagcttaaagcaattgaaaatcccaacttgtttgcgtgttgcaaacaggctgggattttttaatcacgacattattcagttgttaaacgttgatagtggacttcggcgagctgaccatatcgattggtgtcaactaattcaaagcgctgttgctggtcaattgctttaaataagggaataccatcacccaaaatgactggtgcaatctggatgtagagctcatcaactaaatccgcagctaacagcggcattaagacgccagcaccgccaacaatccaaatatttttgccagcggtacgtcgcaagtcttcgacgatcttcgtgacgggggtattggtgaactgggtgcgttcatcgccggtgtgggggtgggaagtcatgacaatattgtgggtcgccggattatatggattaatgagttgatcagtggtttgttccatcgtgtattcgtaagtatggcggcccatgatggcggtatcaacttgctgcataaatgctttggtgggggcatcgttggcaccagctgttttgaacagccagtccagccgattatccttagtggctaaacaaccgtcaattgaaatggccccataaaactgaactttacgcatgattcgacacctactttatctttagtagtcatattgtaccatgttttccggtcattcacttgctgaactctggtaaaagttcagtaacataattaaataattggttcgaaatgggaggtggggaactactgaaggtgtcgctgggagcgtatgaatactgcaaataatgatgttgtggggctaatggggatgagtatgcacagtgggttaagcaggtcgtggtgatcattgtcagagaggtagcatcggccatcaagatgtgagtcgaagtaacgattggtggttttcaagggccccaccgtccgctataattggattagcatttcatcacatacagtttgacctaattaggcgagctggcctggttcgtaaacttcccaggataaaaaaccaagaacttcagttatcggaggtaagagaatgaatgcgacgcgtaacgttattattgactgtgatcccgggatcgatgatagtttagcactattattggcgcttaaatcaccggcacttaatgtgattgggattacaattgtttgtgggaacgtgccaacccatatcggtgcggaaaatgcactgaaaattttagatttggctgaccgattggatattccagtctatttgggcgctaatcgcccattggaagtcgcctacacgagtgcgcaagacactcacggcgatgacggcttagggaatagtcagattccagcggtaacggcggtacgaccgattcaagatgccgctggttttattgaagagacgctgattgaagcgcctgatacttcgattttagcgttgggaccgttgacgaacattgcgacggtattgcaacgtgatccacacttatttgaacaagtcgatcaatttacactgatgggtggaagttatcggagtcacgggaattgttcgccagtagctgaatacaacttctggtgtgacccggatgcggccaaggtcgtctttgacttgatgcctgttcccattcagatggttggtttagacgtcacgcgtaacatcgtgttgacacccagtttattaacgtatattaaagacgtcaatccagcaatgggggcgtttgttgagaaaattacaaggttctattttgactttcattgggaatacgaacgggttattggttgtgtgatcaatgatccgttggccgtggccggaatgcttgacccgacgattctgagcggctttgaaagctacacgacggtcgtgacggatggtgtcgcgcgtgggcagtcaatcgtggatgatcatgatttctggcacaacacacccaatagtcaaatcatgacgaaggttgacgtcgtagctttttggcggttgttcttaacgactgtggtcggtgcggctgatcctgatttaacgcaagtcttgcaccaattggtgagtgcatgaagagaataaaaacgcgggcaattacgttattggcgctctgcattgccctgaatattgttggcagtaacattgccttgatgttaaaattaccgatttatttagattcaattggtaccgttttggctgctgctgtgtttggaccgctgggtggaatgttggccgggggtgccaccggagttatagtgggtgcgacgacagacctgtactcgctgttcttcatgcccgttcaactgctgactgggttagttgctggtctgctatatcggcgaatcaagccgggcacgtggcggtcaaattggtggctagctggtgttatttcacttcccggaacacttttatccacggcgattacggtcatcttatttcatggcatcacatcgtctggttcgagcatgctagtccaattattattaggtaccggtatgggcaaaacgatggccgtcttcttgatacaagtgggaacggattatttagatcggtttatcacagtgtacgtggtcgcacttgtttaccgcgcattgcgatataaattgccgcaagctaattagttgaacggatgactaaatctaagcatgtttacgctaactcgcactttttccagcgggccgaagcaggctgtctttgagcttggtaaactctagctttcgatttgtagtacctgataagttgtgtgaatatgaacaataaaaatgacctcgcaggaatattattgcgaggtcatttttgttgttatgaggttaaagtgcagtggtcaatatcgctacgaatcgcggcgactcatcttaccatcttcaatttgatagaccacgtcacagtcatcaattagccgctggtcatgggtcaccattacgatggccttttggtgctgatgagcttcgttgacgaggcgcttgacgacgtcgatggagcggggcgtgtccaggctggcggtcggttcgtctgcgagaatgacgcttggatcattgtaaagagcgcgggcgatggcaacacgttggcgttcaccaccggagaggtcacttgggtaggcatcccgaacttcagtaagggctaactctgctagtaattcatcggtgcctgcttgatcaaatttgcgccgggccattttatcgacgagcttgaactgttcacgaaccgtcaggaatggaatcagattggaactctgcaagataaagccaatttcattgaaacggtaggctaagcgctgtttttccgtttgattcgatagtggttgtccgttcagaataacttgaccacttgttggcgtttgtaaaccggcagcaatcgtcaaaaaggtggatttacctgagccagaggggccgataatcgcgacgaattggccagcactgacttcgaaattggcatcagtcaaagcgttaacagcggtatgaccgtgaccaaattgtttattaatattttgtaaggctaaaactggttgactcattgatatcatcctccttatccaatggcaacgacggggtcaatcttggcgacagtccgccatgagagtaaggcaccgacgactgcagctaacaagagagccacactataaataccaaattgtggccagtcaatggcgaatggtaatccggcgggcatgatttgcgcgaggcctaacgtaattagaaggccgatgccgataccaatgattgccatgacgacactttgggtgagtagggcagccaagatgtgtttggtaccaataccttgtacttttaagaccccgaacaaggcttgtttttgaagggtcagaacgaacatgaaaattccaatcacggctagggcaattgcgaacaagaagtaaatcatcgtgttgagtgtcaactgctcagcgctgtatcctggtaatttttcaataaacgtggcaattgataaacgttgcatgttgccatgatgttgagtcttaaaatgactctttttagtcacaaaggcgttgaccggttgttgatcgccactggtgatgggattacctttgagacgattgagcgtggcaacgtccgtgtagaccgttggcgcaatactataggtactagctttgaaagtaccaacgattgttaccttttgatcagtggtcccaatgcgaactttctgaccaatccgatagcctttgtcttttaatcccgcggaaatcaataattgattcttgccgttgattcggtgtcctgagatgacttttggcatcagaaaactatcgtgagtggtcccaaaagcgctagcgttagtcttttgaccattactggcagttcgtaaagtaccggacagactagctaagggtgcgacgtcctgacctttgattcgatcttggtctgctagttttaattgggatgctgacagtgtctgattcgcatcttcgttcaaataaactgtttgagcatgccactggtcaacagcctgacgattaccattggataacccgttagcaaggcccgctaacataaagacgacgagggcaattagtagcaaaaccccgctaagtagcccatatctgagtttttcgtgggccatttcttttaagcctaaatacatgtcaattcctcccttttaatttcatttatcaagtgataaattaaatgtggtaatcgtatcacgttcatttttgtaaatcaaattttttatttaattaccaggctaaattatttcgaaatgggtaccaaggctggtatgattaatttattgaatagagaggcaggtaattattaatggtgaacaagcagttcaatcatcgggccgcagttattgctggtgtgactggtggtgtgatttctggtttagttaagttagggtgggagaatatcctaccgccacgaacgccacagcgggatcaaacgaatcccccacaacaattattgcaacaaattgggattcccgccagcgttacgcatgcaacgtattcatattctggtcatgatttaccaggtgtcagctatgtcatgcatttcggattctcaacgacctttgctgtggcctatagtttatgggctcgcaagcacccccgggcaaaaggtggcagcagcgcgttgtatgggttaggtatctggacagcctttcaccatggtatcttgccagcactggggaccgttcccgctgcgaaggatcaaccaatgaccgaacacgtgtcagaagccattgggcatgttttatggatgtggaccgctgattgggttagtgccgctgtctatgaccggatgacccgttccaaatagcggtttaaatcggttagtgagtgacgacatgatgaagtgtcgtaatcgcaaccgttgaataaagtttttgcttaaaaaactagcttggttaggaatgattacaactgctaaccaagctagttttaattgtcgctattttggttaatgttcggattctgatggtaacggaaatagtgattcaccgcgacaatcacgtgattatgaggaaagcaactgagattaacgtctattacaatgggaccatttgattttaatgattgattttttaatttaattctcatattgactgaaaatgtgctaaaatattaatattgtgtgcaatatttcataaaaacatccataaatgagaatggggcggaagtagcttggaaaagcagggaaagatgaagcggtatcgccagttccgattgagcttgggctggcagatcttaattgggctagtgcttggaattgtattaggggtcgtcttttatggcaataaaacggcgattactgcgatgcaaaacatcgggacgatgttcatcagtctgattcaaatgatcgttttaccaatcgtggtggcatgtctgattaccgggattgctaatatgggcgacctcaaaaagctaggtcggatcggtggtaaaaccattatctatttcgaaatcatgacgacgattgcgatcgccttagggttgttaatgggtaacatttttcaccctggtgactatatcgatattcatcaactacatgcgtcgaatattagtcagtatgtgcaaaccgctaagacggtctcacacaatggtatttggtccacggtcatgggcattatcccgactaacgtctttaaatcattgtcagctggtgacatgattccagtcatcttttttgccgttttctttggtttagggacggcggctattggcgaacaaggcaaaattattctggactttatgaacgctgtcgccgaagctatgttcaaagtgacgaactgggtcatgcacacggctccgattggcgtctgtgccttaattggggtaacggtcgctgaaatgggcttgaaggcgctggcccctttaggctatttcattattcttgcttatattaccatggcaatctttattgtggttgtgatgggcattgttggtaagttattcggtttaaatatttggcacctactacgggtcattcgtgatgaaatggtgcttggcttttcaacggcgagttctgaagcggccctgccccgcattatcgataagatggggaaatacggtgttagtgaaggaattgtctcatttgtgatcccaactgggtatacgtttaacttggatggctccgcaatttatcaatcgttagcggcgcttttcttagctcaggcttatgggattcacctgtcactcagccagcagatcactttattgattgtacttatgattacgtcaaaggggattgctggtgtgccgggggcttcgtttgttgtcttattggcgacgatttcaacgattggcgtgccagtacaaggactcgcttttattgcgggaatcgaccggctagttgacatgggacgaaccgtggttaacgtggtcggcaattcattagctgcggtaattatcggtaagtcagaacatgaatttgatacggccaaaagtgatcagtatttagctgagattcgggcggggcatgcgcgcgcaattacgaaataattgaaaacagctctgtcagttagttctgcattaataatgcgatggcgatgatcactgatgattgataggcccaaaagttgtatttcagaaattaatttctgaaatgcaactttttttatgatatcttattctggttacagcaattacttcagcgattaagttatgataagacctataggggaggatggcgatcggatgacaactgatttttcgattgggcaactcgcacagttatttgatatcccagtggcgactttacgctattatgacgagattgggttattgacgccggcacgagtcaatccgcatagtcactaccgatattatgggacgcctcagttcgaacggttgagtaccattaaatatttgcgagcactcggcttaccattagctacgattgccgatttttttgcggcccgtgaactgtccaagctgacgagtatgttaacgacccaacagcagcaggttgaggcgcaattgcgattattaacggcggtacaacaacggatcaatacacgcttggcccagattaaaacggcccaaagtgccaattttgatgtgactgaatgcgtgacgttacctgaaagagcgatggtggctttacgtcagccttatcgccctcaagatgatattgaacttgttattgctaagctacgcgcacagaccggcgcgacgaacgaaatctttctcggcaaggttgcgctgatgctcgaccagcaagccatccaagccggacattttgaccgctatgcgggaatttgtttattatttgaaccgggtgatacggtgccaccccatcaagaacacttggcggctggtagctatgcgcagcggatttttcacggcactcatttggatgccccgatgcagtatcgacaattgttagcggattgtcgtgctcgcggctggcacgtggcgggaacagctattgagacagcactgattgattatgggattacagatcaggttgcacagtcggtgacgcagatacaattaccaatcaaggcttgaccctcaagtaactttagactttatactaaatgataattaattattttaaattgaaataagcgctaaggattaagctattgattaggagtggcgatatgattgggacgatttttaatacgagtatgattttagccgggtgcttagtcggcagtatttttaagaaaggaatcaaaccggcctaccatgcgatattgttgcaagcactcggactagcggcttgcgtcattggcattaatgcggtcgtgcaacggatgccgcaaagtaagtacccggtgctttttatcgtgagtttagccatcggggggttaattgggcaagccctagatattcaagggcattttgatcgctgggtgggccgcttagcgggtggcaacttagcggaaggcctggcaaccgcggtgttattgtactgtattgggtcgctatcgattttaggaccgattgaggccgccttaaagcatgactataccttcttatttacgaacggcatgttggacggcatcacatcgatcgtactagcttcgactttcggatttggcatcgcaattgccgcgggtgtcctgttttgctggcaaggcagcctgtatgttctagcattacttttaaaaggtgcgttgagcacggcgttacttaacgaaattaccattgtcggtggtatcttaatccttgcttccggcttaggtatgctgaaaatcaagcaattcagtacgttgaacctattaccggccttattagtaccaccaatcgtcatcagtgtaatgcaattattttagccagcgagccaacggtgaagaccgctaagcctattaattgacaaagcaaagtcaccaacttaagacaatcagtgaatactgatcatcttaagttggtggctttatgtgtaacgcatcgatttaaaaaactggcattaaatatggttaaaactggactgtttttaaatcaaaagcagccagcttaggcccgcaggaaacagttcgggttagcgtaaacctgctttgctggttcgtcctacaccgacctcccggcatttctgccaattgccggaacgtggtgggcacagatttgagccgaaaaaccacgtctcaaatactggcctttcactaaccaagcacaagacgcttgctaagtgaaatttcaccactgggcattgtcagaaacgccttccagtcgggaaagtgttcgaatggcagatggagatgtacccaacatttggtggacttgtcattgtttttttacaaacagtaattcgtcaattaactttcagattgaagatgagattgtgataacttactatttctgaattaccagtcataataattgaacgtttcgataaattagagaatacatcctgatattgtacttaaagttccagtatcaaaatagccaacgaccaattgcaccaagttaagtggtcgttcatcagccattcgagcggcttaccgactggaggggctgggtgacaatgctcagtagccaaattattcttagtcggaagtgggttgcttccggcttagaataagactcgtatttgagaccgggcgggttgtgcacgggctcaaatcgatgtcggcttacgttccagcaattgtcacccagccccggaggtcggaataggacgaacaagtgctgacgaacaacaatctaaacttggcacgttttaaccataatatgtgtcaaagtaagacacgggttagattaaatggtgtttgatgccgaagagttggcgattgcgttccaggtggcggtgaatgtggtcgatgaggacgtcgtgcgaccaatcggtagttgtgttaagtggcggaacgggaaaacgttcatcgatatcgattgtcggtggcgtgatggcacagttggcgactagggcgatggcgaggctcgtaggtgtgtgctggtacatgaggtcatttcgaatcgcaaacctgatgtgctgctggttggctagtttaacgtagcgattcaggatgtcttcatctagtaagccatgtaagagtaactggtaatcaggatgggccaccatttcactttttagttcggttgagtagtcacgcatgagtgcttgggtgaaagtaatgcccacatcgattcgttcgtgaaacgtgccaaggttacggtgttgttcatccggatgtagtacaggggccccgaatattgcggattgtaagtgtttatccatttggtcttcagaattagccatgccggtcaggtcctttcacaattaaccataagatttaactacttttactactattgtaataaagaaagcgctttaatcaacataaaattttctaaagctgattagaagttacatctttggatgccactaggcttgaaacggatgacagataattaaggacgcaacggatttgccggggccaatttaatgctgttttgaaaacaaggactcggtgcttcataaaataaagaaggtgcccagaattaggaaaggtggcttcatcggcaaataacgaatattcaaggccattttgggaaaagccagcctcggccagacaatctcaattataatctaagtaacggtcaaggctaatttaacaaattgataataaggttactaatatatcaataaactgattaaagcagtgtgttgcttaatgattaaccaggctaaccttaatccttgtcagcattgacttacggctgattatacaagtcttttttttaagattgtaaaggtgtattattgattcgtccatggtatgatactacatagtatgttagtaaagtagtcaatcaaattaaaagagaaacggatggtaacaaatgccaagacatttacggaaacggcgccggtcctggacgctgatcataattgccatggtgcttttgggggtcattggatttacaagcacacaagtttctgactggattgatgcatcgtttacaactaaacaaacggatgtagctaagtctagttcccaaacgaagcccaagtcggtcaatcaggtcaagttggacgtcccgctagtgaatcaaatgacaacaccacgtttatacaatggttgtgaagtcacatcgttaacgatgttgatgaattacgcgcatatcaatgtcactaaaaatgaattagcggcaaagattacgagtgtgccactcacttatagtgacggcgaacatgggaatccagagtatgggtttgttggggatattactggtaacgatcctgggttaggtgtctatcataagccaatctataaattggcgaaaactgagactagtcaggtgaaggacttaacgggggcaaactttgatactgtgattgaacagttagaacaaggacggcccgtttggacaattacgacggcttcgtttgcaccggtcagcacgatgcaaacttggcagacaccacagggctccgttaaagtgacttatgatatgcacagcgtggtcattgtgggttttaaccggactaaaaagttgatttatattaacaatccgtacggagaaaaacagcaggcagtcagctggaagaattttgaggctgcttataatcagatgggcaagcaagccattgttctgacgttaccacattagttagttaacaacatgctattgtgaaccaattagtttaagcaactaatcttggtcaagataaaccaaaatcttgatgaggattagttgctttttttgtagcggcacttgcgaatgaaatgagggcgatgcccggtaatacgggcagtttggctgccgcaaattagtttgagaatgggtgattgcgaaaccgttgtaaccaaactgtaatccaaatatcagcctttccggagttgttcataatattaaccataaaggggcgaagctttgttaacaagctgtaactgaattgaaatcgaattgacgccgcaacccatcgaaaatgacctatcattggtagtataagaatgttaaagttatgggtacgtcataaactggttttaacagtttagttgtttgtaattgtggggattactagcaacttataatgataatttttttaattgcggagcacaatatggggagagggaccgcatgatggggattaaaaagctcagttggttagttggaacggttgtggtcgccacacttggtatgcaaattaatgttcaagcacagggacacgcggtggttgatatttccgagtggcaaggacagctcagcccaagtcaggtgcaggcgatgaagtcgcaagtgctatttgtgatcaatcgccgtcagtatggtttgaattatgttgaccgggatgcagcaaataatacggcattatatgttcgctatggcatcccgtttggtgagtatgatttttcgcagtttacggatgccgtcagtgcgcgtcgtgaagcccaggcgttttatgcgcggtctaataaggctgctcgtttttatgccttggattttgaagttaatacggtccgctccggctcaaccaatgcagccgttgcggcttggtatcacgaaatgcgggcgttgaccaataagaaactgattttttattcgtacgcttcgttcgcactaacgtatgccaaccaagcgcggcaacggttcgacgcccagtggattggagcgctaacacccaacccgccgatcgttccggctgcgttgtggcagtatacagatcgttatcacttagctgggctagctgcgccagttgataatagtcgggtgattacaagcgttcatcccgtttcgtggtggctggggacggaccgtgttgcacgcgttgttacgagtaacacccaaccgagactaaaagttgtccgccatcgccggttgacagcgcccgcccgcaatcaatgggacggacgaggacgagcgacccaaccagttgccgccataaagccgtcagtcgtagtccaagcacagccactcgctcaatcgcaagcacggccccaggttcagccggttgttaagattcagccggagcaccggctggcgaccaaccaaaagacacattggcgggtcaagcggcgggcatcgcgcacaattagcgttaaccatcgtaaggtaattcgacaccgcgtcatttggcatcaagcgacgccgcccaaagtggtaaaacttaaagtgacgcggcgtaaaggtactaagtttaagctgaacacggccagggtaataaagcgtagccaacgcgggcaaagaaatcgaacaaaccgggtggctcgttttaaaggccggacacggcaagggggcacacggcgtcaacggttgctgggacagcgaagaataaggcgtaatcaattccaacggcacgcaccacgagtaacggtgcagcgccagcagtcaacgtttcaccgtgaagcacgtcggccagttcgacgattcacacacacacgtcccgtacataatacttcccgggacaagcgaggacttagctgatggcatggctgtcactcggttctcattatcatggtagcaaaggttattaatggttaagtaaaatcggtcatttgttgtagaaattaggaggacatttttcatgaactttaagcgcaaaattcagttgggaatcgccacggcaactgggatgttggtggttggaatcgttgccgtaccttcagtaacgaacgtactacacgcggcttcagacaatgttagtttggttagccagacagcagcacctacgagcgtcaaggcaactaatcaaacagtcaaggctatcagcgcaagcgggacaaagggtaattaccgggtgaagtacgccaaagctgggactagttcgacgactgcgacctatcagcagacgaactacaatacgaaaagcgatgctagtaaccaagtcgattatttagcgaatacgcaaggtcagcgtacgacgcttaattcaggtacggcagcgacggtccaagggacgatgggcaaagtgtatgttcattggaacacgggtagctggtcagtgacaacgattgccaatacgcaggacgttgccggtaatccaactaagtttgctaatcaggtcaataatcagattcaaaagcaagatttaacaagcaagaatgtcaccagtggcgctgtcacggtatacgatacaccacaaaacggacaggctaactcagttcagtggcaaaacggcaagcaggttgctaaggttcaaggccaacaagccaatacggtcattaaaattgcggcgaatgctaaaaattaggcgtttactcggaagatcagtaaataagcagtgggcgcttggacgtaatcggagcggcgatgctagccgcgtttccgtactgaacgccctcagctagccagtggccgtcaatgcggtgtttcgacggaaaataggattgacttttgtccgtggagtgcttatgatgttagataataattaaaaagtagtgatcgttaattagtagtcgttgacccaacagtctagcgactcggtgggtggtgcgaaccgagctgtggtcaaggatgaattacataacgtgaactgccattggccggatgatatccgttactaatcaatgagcgatcacatttggtgataacttgggtggtaacgcggaaaactcgtccctgttttgatgacagggacgagtttttttgtccagcgacaatcacaaggaggactaacatgaacattatcgacgatttaaaatggcgtggtgccattaaccaacaaacggatgaggccgggttaaaggaacttaccgaaaaccaatccgtctcactatactgtgggattgatccaaccggggatagtatgcatattgggcatttgattcccttcatgattctcaaacgattccagttggctggtcaccatccctacgttgtagttggtggtgggaccggtgctatcggtgatccgtctggtaagaactcagaacgtaagttacagaccatggatcaagtgaagcataatcaggatggcttaagtgctcagatgtacaagttgtttggtcatgacgaaaacttttcgattgtaaataactatgattggttatccaaaatttcattactagatttcttacgcgattatggtaagttgttcagtgtgaacacgatgctgaacaaagaagttgtggctagccggttggaggtcggaatttcatacactgaattcacgtaccaaatcttacaatcagttgacttcttacacttgtaccgggctgaacacgtgcaactccagattggtggggccgatcagtggggcaacatcacggcggggacggatttgattcaccgcttagaaggtaatgacgccaaggcttacgggttgacgatcccattattgttgaaggcggatgggactaagttcggcaagactgctggtggggccgtgtggttaaaccctgagcggacatcaccatatgaattttatcaattctggatcaaccaggatgatcgggatgtcgtcaaatatctcaagtacttcacgttcttaagtcatgaagaaattgaccgcctagccgaaacagtgaagactgcacctgaaaaacgggaagcacaacggcggttagctgaagaagtcacggaatttgttcatggtaagcaggcggtagttgaagctgaaaatattactaaggcgttgtttactggtgatgttcaaagtttaacagcagacgaaatcgaacaaggattcaaaggggtgccatcagccgacgtctctgctgaaaagcagaatattgttttgtggttggttgacgccacaaaattcgaaccttcacggcgtcaagcacgggaagatatcaaaaacggtgcgattcgtatcaatggtgaaaaggtgacggatgttgatgccgagattgatccatccgcagcctttaatggtaaatttgtcattgtacgtcgtggtaagaaacgttacttcttggcacatgttaagtaagttaatttagcaggtggactggacccgttgtggcccagtctttttattattattacaagtaagaactggtgtaaaatttacttaggtcacattaataatgtgtgatcattgccagatgaaaatcaattgaggagatgaaagttttggtgggggttaaatttaatacacggacgattgcaatcctggggatgttgatcgcacttaatgttgttatttctatctttttccatatcccaatcccgatgacacacggttatattaacttatgtgatgcgggaatctttattgcagcactgatttttggctggcgtggtggggtcattgttggcggtgctagcggactattactagatttattgctagggtatccacagtatatgtttttctcactactcgttcatggtttagagggcggaatagcaggatatcttggtgctagcaaatcacatggtcgacagattgcagcgataattactgcggtagtggtgatggtggtcggatactttttgtcagattcgctgttgtatacgatggcaactggattggttggtgtaccgactaatttagttcaagctgtggttggtggtatcttggcattcccaattgttgcaggaattcgaccaatcgttaaacgtcatttaaatttttaaaattaaatgtgctggcttaagacaagcgttcgtcgtgcttttacgggcgcttttttgctgtctaaagggaatccttaattggaaaacatagtgccatctcacaatgatgttaatcgctgacatataatgtagtaattgtgtaattgacgacagttttgtgccgttcttttcataaaagtgaaaaaacattggattaattgttgacagtttcataactggctggtatattagtaaacgttgctgctacggcagatgcatctcaccaccaaataattattgaaattagttgttgacaacttcttcagtaattggtaagatagtttctgttgtcgcaacggcaaccacgacaaattaatcaagttacttcttaaaaaaaagttgttgacaagatattggttaagatgttatgataattaagttgtgttaagtgtatggttagctaggggtagcagcggtcaaggttcatgtcaaagtgttgctgtaggctcctggtttggccgtgtttttgggaatcgtcaaagtgacgtcacttggatcccaaactttaaccgaagtgcctttaccagcgccgttagcggtggctctgcagaatgacacaagcgtcgcacatcgactgacgataactagaaattatacgatgttgacacatggtcatgctcgttcagttgtggcgagtctaatttatttggaagtgttgcatgcacttcatcagggacaagcgttgtctgctgcactggtatcggtgcatgaattgctaatcagtacgatcaaggatatgacacttttaggtgaactgagcacatatggcgcattattttcaccagacttcgcccaaacaaaagccggagtcattcggactagcggttacgttgtggataccctgttggccgcatgttggttagctttaaactaccagacgccacgggaagcggtgttagcggctgttaactttggcggcgatacggatacgattgctacgattaccgcggccttaactgctgcttggcatcctgatattccggtggataccaagtggtggcaacaaaccttaaaccatcaactgctcaatgcccattttgaggtgtttactgctaaatttgcgagcagctagctgacggttagtctgtcggcgtgaattgtttggatgtgattaagtagcttaagaggcgttctcgggatatgtttatcggtggtctggtgcaaagcgctcacgaataacgtgagtcgttttcaaaaaacaagcgtttaaaatcataattccacacaaaaagccaccctgacatgttaaacgtcagggtggcttaattaatttaattagttagagcttgatgaagatgaggttgaaaggtatgacgataagatatccttcaaatcgttatccttgattgaaacgttcccacccttaagcactttagaaacaacgttttgtaagacagtggagtcgctcatatcattgtcccaaatttgtttcttcaaatcagcggtgtgatcagacatcttacccttaccagggttcttgatcatccggatgatttcataaccgttgctggttttaacagcggaagtcgtgtattcaccattcttcagcttgaaagcagccgttaagaatttagatgagtagctcgtgttagtgttatcaaaggctgataacttaccaccatcattcttagtcgttgtatcagttgaatacttcttggctaacttcgtaaagttggcttggctagaatccttcttcaaagcgtctaagactttgtcagcagttgctgatttggcaactaggatatgttgaaccgtgactttaggttcgtaagacttccattgcttcttcaaagctttatcagtaatcttgaccttgtctttaacggcttcctttaataataagttagaacgtaattgttccttgaaggtcttggtcgtcaaaccattttgcgataagacggttgagaaagaactaccatattgtgacttgtaagtattatattgcttcgtcacttgcttagtcgaaacttttgagccgtaatccttttcgagcaccttattcaggatcatttgttgcaagacttgcttacctgaagaggttcccttcatactactgtaatattggctttcggtaatcttaccaccggaagttgatgcaacggtcttgctaccacaaccagctaaggtgaaggttagtaagacaccagcaagggcaatgagccatttcttcattcctaaaacacatcctattcttgaaatcgttctgcattagcagacttcaacgactactataccatatctattaaagcttctgcatgcatatggaaatctttacaaaattttcagagatttcacagcctcttcataaattctacctaatgcgtcagtgaatttaaacgaaacaagcttgttaagatagcaaacaaaagaatcgtgggtcgtatgcgaccacacgattctcaattagtcggttgtcttagttaaatggtctaaagtatcttgtaagtgatccgcacgctttttcatgatggcgacgtggggttcgatcttaaactgaaatttatccaattcagtctgaatgtcatcaaaaacctccgcggcgtgggccatttgcacactgagattgctctgagcatcgctaaactcttcacgcgcgtcttgtaagttgtcagcggcatctaaaacgtcttgcacgtaacttttgatgtctgtgtagagcgctttaggtgttttttgattgatcaacatgtaggtagcagcactgagacccagaccaatcaagctgttacgaataaactttgccatggggggcctcctaattagctaattcagttttaatggcgttctgtaagcgagtgtagtcggtttcgtcatattttttagcgttgtccttaaagatcatccgaaaatcatctttatcgctgtagcggggaatgaggtgaaaatgggagtggaagacggactgataagcgaccgcaccattattgttaacgatattcatgccaatgatattctcgtcagttgctttgatagcgcgggcgatttcaggaatccgcgcaaacacgatgctggcaagatcacgatcgtaaccgaaaatatcggcaacgtgcgtcttcggtacgactaaggtgtgaccaggagtaccttgcgagatgtcaagaaaggctttgaccatgtcgtcttcataaacggtatagctcggaatatcgcccttaattattttacaaaagatacaatcgtcatcgagttttggttcaaaagctgtcatgtgataaccttctttatttattagttgggttcattatacactatcggcgttgtggcaatcaaaatcaggtggtctgattaacaataatttactgaagtttcggtaaagtcgggggtcaatgagccaaccaaatagagggtgtcgtgatggctatgctataatgggagcacttataccaacacagaaagaggttaacgttatgacattagcggtacaacacttagttggtgggtattcgcaaattcccgtcttaaaagatattagttttcaagttgaacctggtgaattagtgggcttgatcggacttaacggggccggaaagtcaacgactattaatcatattatcggtttgttgacgcccatgaagggttcaattgccctcaatggtgtgacattggcacaatatcctcaaaactataagagccaaattgcgtacattccagaaacacctatcttatatgaagagttaacattaaaagaacatctagaaatgacgatgctggcgtatggtttagaccaagaacaggcgtggcaacgggctcatgacttattgaaaactttccgattggctaacaagttggattggttccccgcgaacttctcaaagggaatgaaacagaaagtcatgattgtttgtgcgttcatcactaacgctaagttattcattattgatgagcctttcttagggctggaccctttggcggtgcacgacttgttggcattgattgcgacagtcaaagcacagggcgccgctgttcttatgtcgacgcacgttttggacacggctgaaaaagcttgtgataagtttgtattattgcatgctggtgaagtacagacacaggggacttttgctgaaatcaaagcgaattatccggatgcgggtgagtcgttaaacgatatttatctttcattgaccggggtgactcgtgatgaatgagttatttcaaacgcggttgcagcggcatctgcgtcggatgttgcgctacctaagattggtgttcaatgatcactttgtcattgcattaatgttttttgtcggcggactcgggctggcttattccaattggctcaagacgcttggccctcagcagacgtggatcgtttgggtgctcggtctcttattatgggcgggcctaagtgtcagtcatatcgcaacgttattagaaccggccgataccgttttcctgttaccacgtgaacgggatgtgcatgcgtacttcgtgaaagcgtggcgctatagttggtggttggcacaagcagtccaagtggtttttgttggtttgaccgtgccgttgctcatgatcgttgatcagatgacgggctggtcgttgctggcgttactcatcacccagttggcgctaaaggatgcccagttaacgctgagcgtgacgcatctctatcaagtgaagccagccatgcagcggtggttgcgccccctgaactgggccggcgcgttcgtcacattggcagtgggactactagtgacgccgtggttgagtgccgtaatggccatcgcgattgcggtgggacaacgttatttgcaccaacgaatttggtcgaccacggtgattgcttggcgtgacgacatcaaagccgaagccaaccgtatgttagggatttatcgattctttaatttatttacggatgtaccaatggtgcaaggcagtgtcaaacgtcgtcggtacctggactggttactacggtggttacctaaggaccagcagcatgcgtttggctacctatatacacggggcatgttgcgcggcacggaatttagcgggttagtggttcgtttgaccgtcatcggtgcggtgctactgtactttagtgggcacggttggttagcgatggcgttggacgccttatttatttacttgattgggtttcaattgttgccgttttacaagcaatacgataatatagtttttacgcacatttatccgctggcaactaaacagcgggtgaaaaactttcagcggttattgcgaaacgtgttaagtttgacgggattaatctttttagttgcgttctggttaagcaacgcaccgttagctcaagttgggattttgctcatcattaacgtgattgaaatctatctcttagttacttggtatttaaaattaagattagcttaaaaccttgatgtatcaagggttaaaaaggacttgacggattcaactttcgtctataaaatgtgattgttaagtcaaataataatgagtcattaaataaattttgagaggagtggggctgatggatttcgaacttgatgatggctgggacgtttatccgatctatgggaatacgaataaagctttcatgggcaaaaaaaatcaccaacgattgttcttaaagcgaaacgcctcgccgttcctagcggcgctgtcgatggaagaaattaccccgcgattaatctggacgaagcgtatctcgagcggggatacgctgacagcccaagagtggttgaatggtcaaactttaacgaagcaacaaatgcggctgcctgaagtggcgcatttattggcacgtgtgcacaattccgagttgcttcaccggatgttaagaaaagtcggtggtcagagtgtccgcccacaagactttattcagcaatacttacaagatttaccagatgatttacggcaccatccgttaatggcccgggttctggatgaattgagaggaaccgcccccactttaccggccactgattatcgcgtttgtcacggtgatcttaaccacaagaactggttactatctgatcgccaacaactgtacttggttgactgggattccgcccgatttgcggatccggcgtcagacatcagtatgctactgtgcgaatatgtcccgttaagtgattggcaacagtggcttagtgaatacggtgagactatgacgaccgccttacggacgcgagtggtctggtatgctaagattaatttactattgaatatcaaagataattattatcggaatcagtaccatcagatgaaccatgaaattatctttttagaagaattatcgcagtacgaagtgtaacgacgagcaacaaaatcgccgcgagtcccagatggaattcgcggcgattttgttgagtaagcaaatgaagaaggagtcaatcaagatgcgtgtcagaaataaaccgtgggcgccaaagttaattgccgcccatcccgaacttattaccgaagatccaactcagttaaaaggccgctggcaaagccgttttgccaaaccccagcccctccagattgaagtggggagtggaaaaggccagttcatcattgaaatggctaagcgtcatcctgaaattaattacgtggccattgaaattcagacctcggtgattgcgattattttgaaaaagctagtcgaggcaccgttgcctaacctgcaattggcacatgcggacggtcaagcggtgactgcctttttcgaaccccatgaagttgatcgcttatatctgaatttctctgatccgtggccgaagtcgcgtcatgaaaagcggcgtttgacctacaagtcgtttttgagcagttaccgggaagtcttaaaacccaacggtcagatcgaatttaagactgataaccgggggctattcgaattttcattaacgagcatgaataactttgggatgcaatttgaacaagtttggttagacttgcatgcggttgccacacctgaggataacgtcgagactgaatatgaacagaagttcagtgcggcgggtccgatttataagattattgcaactttcccagcaaaatagactgaatgagaacagcgaaacgcgtcggcgatcgctgttttttaattgagtgtaattgtcggaaacatcaaaaatgagcttccagaattttaattccagaagctcatttttgatttttgatgcggatagtcaattgtgagttattaaagccggtaaatgtctaaaatactaccagtattggcatcggccaaaaactcgtactgtaccagctggccatcttcatagcgggtaatgccgccatagtagacatccgtgcgcaatgcgaacttttgtaatggggattttttcatttcaatccacgagccttcgatcggcgcttcctttaaaaacgcgcgcttgacttggctaagaatttggttaggggtggggcggcgcaaccgcttgaacaggccgccaacggaaaagcccccggcgataccagccatcccaaccgctaacaagccgccatactgtaattgtttattcatgatgttgcgtctcctttcagctaacttgactaggaaatgttttatttaaatttagtataccaatgattgacgagaatacaaagaaaagtcataattaatcagtatgatttaagtaaaatacgctataataatatattgaacgctaaaatgagagtaaaggggtttcacatgttaattacaagttataatccatccgaattaggtgacacgttaatcaccattttacgaccagatacggccacccaaacgattgaaacacatgccaatgtgacgcgtattagcgatgctgacagtggagaaaccttgggctataatttctttgacgtttccaagacgttaggcgacttagatgccaatggtcaagttcacttaacggccgaacaagttgagcaattaaataatttattaaaaaccaatgattttgaacctgaattaattttagacactgaccctaagtttgtggtcggctatgtggaatcagccgaagcacatccgaagtctgatcatttacagattaccaagacgaatgttggtttggatcaaccacttcaaatcgtgagtggttcacctaatatgcaggcggatattttggttgttgttgccaaggtcggtgcaatgatgcccagtggcttaattatttggccgggcgaattacggggcgttgagagtgatggcatgattgtttcaggccgagaattacaattaccgaacgcgccacaacggccaggggctttgattttgcccgccgattatcagccagtgggtgcggcattcgattttaaacgcgctcagacgttatttaccgcttaatttgcagatattaaaaactaggatgattgaaaatgaaccattatgatggcccggcatttttccggaaatatcgatttaacaaaccacaagtgaataattcagcggccagtcaatcaactcctgtagcggcatcggctagtccacaatcgactgctggtgcacctagtgcggcgccaaagcggccagccagtaagcaggtgacgagccaggcaactacttcgagtagcagtgcggcaactagtgcgaccctgtttaacgggggcacccatgggacttttcacccatcccgggtaccggcccagcttagtgcggcgttgacaaatggcggtatcattcaggatcacgatgaccgtaattatttagaaattgaagcgagcttgcataagcgccccgagaccttcttattgtttgcggatgcagcagctattgatttaccggctgttgatttgcaacaaccgctttctgatagtgggactgacacgagtcaagttgaacacccgagtgattcagcaacgccgactgcggcagttcttagtcaagcggaacggcagatggcttcaagtgttgacccgacaacggtaactagtcaggcagcatcgagcggggctgctcaaacggtcgtggctaacacgtcacagaccggcagtgattccacggtgtccgcagcttcggcgacggttgtgcgaccaacggaagtgtttgaacctactactcctgaattagctgtgtcggctgcggcaattaatacgcctaaaaccgatgattcagtggtagtgacggctcccacggaagtatttgagcccactgacccaagtttagcagcgtcggcagccgccataaatgcgcctagcgcggtaagttcggcagtatcggcaggccccacggaagtatttgagcccactgacccaagcttagcagcgtcggcggccgccgtaaatgcgcctagcgtggtaagttcggcagtatcggcaggccccacggaagtatttgagcccactgacccaagcttagcagcgtcggcagcggccgtaaatgtgcctaatgcggtcagttcggcgatatcggcaggtccgacagaagtgtttgaaccgaatgaccccgcgcttgctgaatctgctgcaactgttaatgcggctgctgatcatgatgaaacagaatctgctgcgactagcgcgacacccaagtcagcacatgggctaggcctatccttaggagatattatgaccgctgaacacgatgcgcaggcggacttagcgctatttaaggatcagccaacaacggcagcttctgcagcaccacaatcaagtcatgcgcagacgcgttcacacgttaacgaagaaccttatcaaccggttggcatgcggccaactagcacaagtcctgcagtgacgtcggcaacggccacgccagtcagcgttgtggcatccacggtcccttcacaagaaagtgggggagcggctagtgtcactatggcaccgtcacaggcggctacttctgcagttaccactagtcccgctttatcagaaacgtccgcagtggcttcacaacctgagttagttcatagtggtggttcagcggcccccgtccttgaagacaaagaattagcggcttaccatttgccaccgctgaatctgttgaaagcaccgatcgtggccaatgaatctgagatggatgattggatcgagcagaaggccagtgcgttagatgaatctctggacgcatttggtgtcaatgccaacgttgtcgattggacgatcgggccaaccgtgactcagttccaagtaaaacctgctcgtggcgtcaaggtcagcaagattaccaacttaaatgatgatttgaaattggccttggctgcaaaagatattcgaattgaagcgccgatccctggccgtaatacgattggaattgaaattccaaatgcaaaatcgcggccggtgatgctgtccgaagttttagattctggcaaattccgcgacagtaagtcaccattgacggtcgcactcggtgtcgacttattcgggcaaccacaagtcactgacctgcggaagatgccgcacggtttgattgcgggggcgacgggttctggaaaatcggtcttcatcaatagtatcctggtttcgatcctgtacaaggcgaacccacaacaagttaaattgttgctcattgatccgaaggccgtagaactagcaccatacaacgagattccacatttattagcacccgtgatttcagaaccaaaagccgcttcagcagcgctgaaatgggtcgttgatgagatggacaatcggtatgataaactggccgctggtggtgcccggaacattgaacaattcaacaaactggccgacgaacatgatgagccggcgctaaaaatgccgtatatcgtgattgtaatcgacgaattagctgatttgatgatggttgcttctagtgaggttcaggattacattgcccggattactcagaaggcccgtgcggcaggaattcatttactagttgcgacccagcggccaagtgttgatgtggttactggtttgatcaagaataatattccaacgcgggtggccttcatggttgccagccagatcgattcgcggacgattctggacgcgagtggggcggaacgcctgttgggacgcggtgatatgttgtatcttggtaacggccaacccgcaccgattcggttgcaggggacgttcgtggacagtgagatcgacagtatcactcagtttgtccgtgatcaggcagcaccgcactatgaatttcaaccagacagcctaatgaagcacgaggaagcagcacgcaatgaagatgacttgatgcctgaagcattggcttacattgctgatgaagataccatgtcgacatcgaagttgcaacgaaacttctcgattggctataatcgggcggccaatattattgatgatttggaaagtcgcggctacgtttcagcagctaagggttccaaaccacgagatgtttatttcacagcggcagatttaactaaattacaagccaattcataattaaaaataaagcgattcacctcatgattgatgaattgtgaatatgggagattattagcataatggataaagcaacggtttattattttgttgggatcaagggctctgggatgagctcactagccttgattttacatgacaagggttaccaagttgaaggctcagatattgaacaatatacgtttacgcaaaaaggtctagctgcagctggcattaagatgctaccgttttccgaagataacattcgcgaaggcctcacagtgattgcggggaactcatttactgatgaccatcctgaaatcaaaaaggcgcgtgaaatggggttgcccgtttatcgttatcatgaatttcttggaaaattaatggaaggcttcacgagtattggtgtggccgggactcacgggaagacgtcgacaactggtttgttgtcccacgttttgagtcatatcgctcccaccagttacttgattggtgatgggaccggtaaaggcacccccgacgcgcgtttcttcgtttttgaagcggatgaatatcggcggcacttcgttgcttaccatcccgattatgccatcatgacgaacgttgactttgaccatcctgattactacaaggatttagctgacgttcaatccgctttccaacaatttggcaatcaagtgaagaagggcatctttgcttggggtgacgatgaaagtttacgacacctcgatgttgataccccaatttactattacgggacgaatgaccgtgacgactttcaagcggtgaacatcaaacgaacgactaaggggtcttcatttgaagtgaagtatcacgatgaatcgttaggggaatttgaaattccattgtttggtgaacacaatgtcttaaacagcacggctgtcattgcggtttcttactttgaaaaggtgaacttagacgaaattcggcgggaactcctcgactttagtggggttaaacgacgtttctcagaacatcaagttggcgatatggtcatgatcgacgactacgcccatcatccatcagaaattaaagcaacattggatgctgcacgccaaaagtatccggataaggaaatcctggccgtattccaaccacatacgttctcacggacgaaagcattgatggatggctttgcagccagcttaagcaaggcagatcacgtcttcttgaccaatatcttcagttctgcccgtgaaaaatccggcgatgtttcctccaaagacttagctgctaagttgcctaatggtggtgaaattatcacgaccgatgacatgtctgctttaacggcttaccacaatgccgtcgctgtcttcatgggtgctggtgacattcaaaagtacgaaaaaatttatgaagatcaaatgaaataatgtttaaaaaagtggccccgctggggccgcttttttagtctgtctttaaattgatttagcgtaaaccgacgtcagcggccaagttggaaaccctatgagggatgttagattattgctagacaacagttgtgcgacctatttggaccttagaagttttaatgaaatttatgcagccgataaataaagcaccaatgacgataattcattcgaatctcgtcattggtgttttattagtgtgtctgattttcaagtattaattacgtgaataggggagcaggtgtaacagttttagttttgttgtttctgggccttgtttaacatttttttagcttcacaatcatagtcgcaggccgcacatttgccctttttagcacgtttgaccacgtgataaatctgataaccagcagccccaataattagtgcgataatcaagaaattaataaataatgccatgtgaatcaaactcctttcagataaataattgaccaacttggtaaatgacgaaggccaaggtgtaagcaatgactaaactcgagcagacggcgtaaaccgcccacttggtcgatccagtctcggacttgatggtcccaatcgtggcgaagcacgggacatatagcaagatgaagacgagcatcgcgtatgcggataacggtgtgaaaaagcgccccatcatggcaatcaagccggcctgatttgcgctgtggaacatgaccatcatactagagctgatgacttctttggctagaatcccagtaaagagggctgagataacttgccaggcggtcacaccaagtggcgcgaacagcggtaatagtgtcttgccaagtgtcgcggcaaagctgttatcgatgtcgctgactaagccgctagtgccgaatgaggaaagtaaccaaatcaagaccgtaccggcaaagatgatggtacctgcctttttgatgaagcctttacccttatcccaggtcccgcgccaaataatgtcaacccgggggatatgatactgtggtaactcgacgatgaagacggaactgtcatcgacgttgaaaatcagttgataaaatttagccatgccgagggcgaccgcaatgccaagaaagtaaatcgacaagacaattagggcctgatttttcgggaaaaaagcggccacaaataggctgtagattggcagacgggcggagcaactcataaatggggaaatcagcgttgtaattaagcgttctttaggttgttcaattgtccgggcggccataataccagtgacgttgcatccaaatccaataattagggggataaatgccttcccgttgagtccaatcatctgcatcaagcggtccgtaactagtgctgctcgtgccatgtaacctgaatcttccaagattgaaatacaggcaaacaagacaaaaatttggggaataaagacgagcacgccaccgacccctgcaattaggccgttaacaatcagtgagcgcaagaccgggatggctccagccatggtcaaccagtgactcacggtggtggatagtggtccggagacgaatctatctaacaaatctgacaggggcgtgccgacccaatcaaaggataatttgaacatcaagtagaagattcccacaaagacgggtagccctaagaacggattggtgacccacttgtcgattttagcagtcatctcgacgtggctagtgcttgccaagttttgactagcgctggctagggtttgctcaataaaatctagtcgggtttggaagatctgctcgtcgaatttttgagcgtcgtaataagcggcttgactagtaagtggtgtcaagcccatgtgtttcgcgtaggcgcgaattggcttattttgattaataaattgaatcgtcagccaccgtgcgaagtctgctgtcaaatcaaattttttgatgagctgttggctagcctgacgaatggcttgctcaatcatgaaaggatagttgagtttgagcggtgtcgcggccggatggggacctgccaataagtctttgcgtagctgatgcagcccttctttattgcgggcgttagtcgctttgatctgacagccaagttgttcagctagcgtgtcaaaatcataataatggcccgtccgtttgaggtcatcaatcatgttgagtgcgataatcaccggtgcgccaaattccaacacttcgatcgacagtagtaagttacgcttgagctgactcgcgttggtcacgttcagaattagatcagggtggttatgtagcagatagttggtgacgactgcttcatctttggtgattggattaagtgaatagactccgggtaaatcgaccatttcaacttcagagtgccgaatccggcccatcttcttctcaacggtcacgccggtccagttaccgacgtacgcgtatttatccgtcagttcattgaagagcgtcgtcttaccagtgttaggatttccgagcaatgcaaccgtcgtcatcttaatggcctccaatcaacgtttgaaatacggtgtaccgaattccaattcgttgttgatcaatctgaacaattaccggtccgtgaaacggatagtagcgaatcacggctaatggactgccgacgtgtagccctaagctgtgcaatcgttgaacggtctgattatccaaacctgtgaattgttgaatatgtaattgtgatgtattagtaacggattgacttagcataagactcagtcctctctgaatattccaattgtgaataattcatcaaaaatattatacctacatcatagcatgaaagggcttttgttaatatggggaaaagccttattttcttttgaaatgaaaacggttatactctaagtatagaatacaaaaaggccgatgttacgctatttttgttgaagccgttgactaatcattatatacggaaggaataacggcttgggtaataaattcaattgttggaggatgatttaaatggcaaccttggaagttaaagatttacacgttgaagtgacggatgatgagcaaaaaaagtctcgtgagattttaaaaggcgtcaatttatctatgaaaactggtgaaattcatgccattatgggaccaaatgggactggtaagtccactttatcacaaactattatgggccaaccggcttatcacgttactcagggtgatatcttgttgaacggcgaaagtatcgtcaacatgccagttgatgaacgtgcacgtaagggactcttcctcggcatgcagtatccagctgaaattcaaggggtcaccaacgctgaatttttacgggcagcaatgaacgcacgtcgaccagctgatgatcaaatctcagtgatggcctttcttaaagaactcgacaagaacttggcactacttaatatgagcgaatccatgacggaacgttacctaaacgaaggtttctccggtggtgaaaagaagcgtaacgaaattttgcaattattgatgatcaagccatcattcgccttattggacgaaattgattccgggcttgatatcgatgcgttacaagtggtttctaagggtgttaattcgatgcggggcgataatttcggctcattgattatcacgcattatcaacggctgttaaactacattgtgcccgatgtcgttcacgtgatgatgggtggtcgaatcgtgaagactggtaacgctgacttagcaaagacccttgaaaaagaaggttatgctggtttacgtgacgatttgaacattgatgtcaaacttgttgacgacgaagattagggggtgcagtaatggaagcaactgctgattatgaaactatcaaaacaacgctagctgcggctgctaacgaacatggtgaaccgcactggctcgttgaacgccgtttagcggctttagatgcgatgcaaggcctagcggttcccaaagctgatcgctttagtattcgcgactggccactgacgcccaccgaccaaccactaaagttcagtcgttcggaccgaactttagcaactgatgtaacggccgaagctggtcatatccaaatcgtacaagttgggcagacaacggtaaccgtcaacttgcctgatgaactcgatgatcaaggcgtcattttgaccgatatgttcacggcttttcgtgaacatccgcagctaactgaaaaacattttatgggcaaagtcgtcaaaactgacgaggaccggttgaccagctaccataccgcgtttttgaacgccggggtcttcctctatgttcctaaaggggttactgtcaaagaaccaattgagatcaccacgattcaggatagtacccgcgtgcaaccgttaattagtcacgtcttgattgtggctgaacaagacagccatttcgcagtaactcagcacctgacaacgaagggtgacgtcgataatatcgccaactgtgttgtagaaattttggcacgggctgacagtgaagtgcatttttcagcgttcgatgaactcggggccaacacgactgcttacttgaatcggcgggccgcgatcagtcggggagccaaagtcgattgggctatcgggatgatgaataacggtaacactttcggggactttgactcggaactgatcggtgaaggcgccaaatccgatgccaaggtcatcacagtgacgaccaaagcccaggatgtctgtgttaatacgcgggttaccaaccgtggtaagaagactgacggcaatatcgtacaacgtggggtcattatggaaaagtctaacctgatttttaacggaatcggtcacattattcacggggcatccggtgcacatgctgaacaggaaaaccgggttttgatgatgtctgatgatgcccatggtgacgcgaacccgattctattgatcgatgaaaatgacgtgttagctggacatgcagccagtgttggtcaaattgatcaaaatcaaatgtactatttgatgagtcgcgggattgataaaccacaggcccaacggttggttattcggggcttcttaagtaccgtgattggtgcgatcccatcgaagactgtccggacgcgcttaacgaacacgattgaaaggaagcttgaagatggcatccaattttgagacgttacggtcagattttcccattctaaaccaacaagtgaatgatgaacgacttgtctacctagataatgcggcgactgcgcagcgccccaaccaagtcgtggatgcgctcgttcacttttatcaacacgataacgccaatgttcatcgtggtgtccacaccttagcagagcgggccactagtcaatacgaagctgcgcgtgccaaggtgcaacggttcatcaatgctgcaaaaacggatgaaatcgtcttcaccaaagggacgacggatagtctcaacctgattgccagtacttatggcgaagccaatattcaagcgggtgatgagatcgtcatctccattatggagcatcatagtaatttaattccgtggcaacagttagcgctgcgtaagcacgctaccttgaaatatattgagttaacggcgactggtgaattggacatggccgatgctgccaacaagattacggatcgaacaaaaatcgtttcagtgacccatgctagtaatgtattgggaacggtcaatccaatcaaggcgttagcacgattggcgcatcaacacggtgccctgatgattgcggatggggcgcaggcagcccctcatatgccggtcgatgtccaggcactcgatgttgatttttacgcattttcggggcataaaatgctgggaccaaccggcattggcgttctatatggtcgtgagaatttattagctacgatgccaccgtatcaatttggtggtgagatgattggctttgttcaccgtgatgacagtacctgggcggaactaccgtggaagtttgaagcgggcactcagaacattgccggtgcgatcggcttgggcgcggcggttgattatttgacgcaactcggtatggatcaagttcagcaacacgaacagcaattagtcaattacttattgcctaagttgattgcaatgcctggtgtcacggtctacggtccccaagatccccaacatcatacgggcgtcatcgcctttaatatcgacggtttgcacccgcacgacgcggctaccgcgttggatatggaaggtgtcgccgttcgcgcgggtcatcactgtgcacaacccctgatggcagcgctcggcttagtagcaactgcacgggctagtttttacatttacaatacacaagcggacgctgatcaattattaacgtcactccaagcaacaaaggagtttttcgaacatgggactgtctaaattaagtggcttatatcgcgaagtgattttagatcatggtgatcatccgcatcataaaaatgcgttgccaaacgcaacacatgccattacgttgaaaaatccaacttgtggcgacgtcatcaatttggctattcaattggatgcgcatgatcaaatcgaagatattggatttacgggtgagggctgtaccatcagtcaagcatcggccagtatgatgacggatgcggtgatgggtaagtcgaaagaacaggcattggcaatggctaagacattttcggatatggcgattggcaagcaacacccgcaggccgatatggatgccttagaagacgccgcaattttatcgaatattatgcaatttccggcacgaatcaaatgtgccacgctagcttggtgggctttgcaacgggcattgcttgctgaaaatggcaatgaggaggaatcagaagtatgagtgaagtacctgacgtggtcaaaaatgaccgtgattatgaatatggatttcatgacgatgtcaaaccagcatattcaactgggcgaggattaacggaagccacggtgcgcgaaatttccgcggcaaaacatgagccacaatggatgttggattatcggttaaatgcctatcatgagtatttaaagatgccgatgcctaagtttggcccggatctcacgaaactcgacttgaaggacatgctgtattatcagaagatgaccgataaaaagttccgtgactggaaagaagtcccagctgacttgaagcggacgttcgaccggttaggtgtgcctgaagctgaacggaaatacttagccggttcatcggcgcagtatgaatctgaagtcgtttatcacaatatgcgtaaagattttgaaaagttaggtattatttttaccgataccgatacggcgcttcacgattatccagaactgttcaagaagtggtttgggaaactcgtcaaaccaaccgataacaagtttgcggctttaaacgcggcggtctggtcaggtgggtccttcatttacgtgcctaagggtgtccagacgaagacgccaattcagtcatatttccggttaaatgctgaaaactcgggtcagtttgagcggactttgattatcgtggaagatggtgccagtgtcgactatgtcgaagggtgtacggcccctaattattcttcagatagtttgcacgcggccgttgttgaagtcaatgttgagcccaacgcttactgccgttatacaacgattcaaaactggtctgacaatgtttatagcctggaaactaagcgagctgcagcggccgaaaatgccacgatggaatgggtcgatgggaatttaggttcgaaggttacgatgaagtacccaagcgtttatttgaatggggaaggtgcccgcgggaccatgttatcgatcgcggttgccagcaatggcatccaccaagattctggtgctcggatgattcataatgctaagaatacctccagttcgattgtttcgaagtccatcgctaagaccggtggtgcgaccgattatcgtgggaccgtgcgttttgccaagcattcagacggttccaaagcgcatgttgagtgcgacacgatcatcatggatgaccagtcgtcttccaacacgattccgtataacgaaatcgacagtgctaacgtcgcgatggaacacgaagctaaggtgtccaaaatctctgaagaacagctctactacttgatgagccggggaatttcagaagcgaaggcgaccgaaatgattatcatgggattcgtagaaccatttaccaagcagttaccgatggaatatgccgttgaattaaaccggttgatcagttttgaaatggaaggatcaatcggctagtaaggggtcaagtgaaatgaaaaagacacgccgcgtcttattaggattagcgctcattattgggattaccgttggtgctggctgtcgctcgactgggagtcagtcgaaaaccagcagtgcctcgccatccacgacaactaagacggtaaccgacatggctggcactaaggtcaaaataccgacaaaagtgacgcgggttgctgatctctggcacgctaataatcaggtcgtcttgttattaggcggccagaaaaagttggtggctaccacgcagatgatcaagcagtcaccgtggttcaagacgattgatcccggaatcagcagagtaactgcgccgtttgcgggtgatgaccttcagacagaagaattgttgaaagccaagccggacgttgtgattgcagcggatgctgcccaggtcaaacaggcgcggaaggccaagattccaaccgtcaacgcgatgtaccaaacttttgcaggtttacggcagtccgtgaacttaactgcccaagttctgggtgggacagcgcccaagattgccaaaacgtatcaaaaaacgctgacgaccaaccttaatgacgttaagacccggctcaagggtgtgacgaccaagcccaaagtcctgcatttcgtgaacgcgacgaatttgaatcaagtggacggtaccgggacgatcgtggacgagtggatcaaagcggctggtggtcaaaatgcgttgacacaaaagggcaatatgatctcggtcacgaccgaaacgttggctaagtccgaccctgatatcattattgttgggagtgcaacgacagccgaggcccgagcggcgttgaagaaaaacgccgtcttgagtaaactaaccgctgtcaaaaagaatcgagtgtacggtaaccctcagggaacgttcccttgggatcgttacagtgcggaggaagccttgcaagtgttgtgggcagctaagaagttacatccggatcagttccaagatctgaatatggtcgccaaaaccaaagctttctatcagcagttttaccattatcagttaagtacggcgcaagctaaccggttattgaatggcgcctcgtcgcctaaataactgccggccaaactagccagcgtgcacggttaaaaagctagctgagaaattattaatttctcggctagcttttttggtgtggacaccgatgctgccatggtttgtgatgacggctaaaactcgcaaatcgtgcggcccagttctgggacgtatagtagtcggagttttgtttggtaagtggctcgtaagcgtggttcggtcagcagctcgatgccaccgtaatcgaagtgtccgctggcaccgaataacccgactcgctgttttaaaattagtgcgtggtttgggttatgcgtggttaaaatgaccgcaatattctggcctgcgagttgttggacgagacttaaaagttgctgttgacggccaaaatcaagggccgcagttggctcatctaaaataatcaattcgggttcttgcatcaaggcacgcgcaattgtgaccagttgggcttggccgccacttaacgtgttgatggtgcgcgccgttaattcactgagctgcaacgttttcaggatgcggtctgccagggcaacatcggtcgcacccggggactgagcaaagtttaagtagggggtgcgtccggtcaatagatagtcacggacactcaaactagtcgttgttggaatcgtctggggcacgtaagcgataatccgcgcccgttgtttgggcgttagtgtagctaatggttggccgttcaaagtgagtgtcccggctgtcggtgtgagtaatcctaacagacactttaacagtgtcgatttgccgataccgttggggccaagcaaagtcaatatttcgccgtggtgcaactgtaactgtaaatcggtaaagaggtcggcctgttgtgggtagtgaaaagctaagtgctcagctgataaaagtgcggtcatagtgccaccttctttgataacagaattgcaataaaaatgggggtgccgataaagcccgtcaaaatgcttaatggaatttcgccagctgataaggtacgtgcgagggtgtccaccactagtaggaagatggcaccaattagtccagacaatgggagcgaccacttggtgttttcgccaatgacaattcgtgccatgtgagggacaatcaaaccaatccaaccgatagtgccactcaagcacacagcgctagcagtcaacatcgtggcactaagaatgactagaccgcgttcccagcggacgttaattccttgggcaaaagccacttggttgcccagggctaagacggttaagcgccagcgcataattagtaagatgaccatgccaacgatgagcaacggcaaaacggctccgagactattgaggtttacttttgctaagctaccaagctgccagtaaacgatgtcttgtaattgtgattccgggtcggctaagtatttcagtaggcctagaattgcctgcatcaacccactgatgacgataccagctaagactaaggctagtgtgctcgattgatggatcagacggggaatcccgacacttaataagacggcgattagtccgagagcgaacgctaaaatctgtgtgccaacggtgtgccaacctaacagaatcgctaatgctgcgccaaccgccgccccatttgaaacacccagcagatcaggcgaaactaagggattttgaaaaatactctgataggcagtccccgagatagcgagagcggccccaattgcggccgcggccaagattcgaggtaagcgcagactgaaaacgatattatgaatgaccggactaacggatgcctgaccggtgagtgtggcggtaagctcactcagacttaattgataacggcctaggcagagtgccactaacatcaatccaatcaacgcaagggtcgtcagtaatagaatgccataaccgcgccgacgtgttttaaccattggctagacctccagttgcgtagccgttttaatcaggctagtcgtgaagtgggcgagccgttgttcgtcggcgccctcgggatgaagatcgataaacaggggttgggcgccccgcgtggctcccgtcgtctcaagttggcgatcaaattcaatcacggccttgcagtagtcgtcagcgtaccaacgatcacccgaccccgcgacgccaaaaacagtgccactgaggtcgacgtcttggagatcatcaaagaagtcgaggccctcttccggtaagtcgccttcgccgtatgtataaggcacgatcacgattaaatcagctacgggcaagtcaaaggcgtcggcttgaccaatctcggtaaaattagtatcgacgtggtgctcacgaagctgattttgaataatttctgcaatctcttcattattaccagttaatgaagcataaataatttcagctttcatgtaaataacactcctttatttttatcaggttattattggttggtgggccgcagcggacgcagatttaagccacaccccacgtcttaaatgttgggacttccgggcaaacgacgcgatgacgctaagtggcaattcaacgtttaacgcgctagcccagctaatcctcactttcgacctgtctgaaccgctcacgctagtcacgcaactagaactttgctcatcacgacaaagctaacgaacgattgcccgacttagcgcgagtaatcgacaacccaataactgttaactatatgataacattctcacgaattgaccattattagggatttgactaattaaatttgaaagcaggctctgacataatagaagggtaggacaagtaggtcaaaaggagggatgcgccatggcgatgattaaattgtctgcgacgccgttggatgtgaatgcgctgtatcaagccttgaaggcgccggaatatggtggcattgtcacgtttgttggcactgttcgtcaatggacgggcccaattgagacgcagtcgatcgattattcagcgtatgcggagatggccgtcagtcaacttgaaaaattagcagcacccattgaagcaaagggcgcccgcgtcgtgatcgtgcaccgcgttgggcatctagatttgatggatgaggcggtttttgttggcgtcgcagcggcgcaccgtgccgaggccttcgaatggtgccaatacttaattgatacgctgaaaaaagaagtcccaatttggaagaaagaatttgataccgacaaagttcgttggggggattaaggatggaactaacgattaagttatttgcgatgctagcggagcaaatcgggccaacggtcacggtgaccgtcacaacgccggcgaccgcggccatggtcaaaccggctttgagccaacgaacgccggcgcttaaagcggtgatcaataatgcacggattgcggttaatcaagaatttatcgctgatgaccagcaagttttacaagcgaccgatgagattgcactaattccgccggtcagcgggggttaatagcggcgttagatttaatgatgaaggaggagcgcgaatagtatggaaaaattatatgacagttatgatcgtttgcatgattacgtgcggttatcgataacggaccgttgtaatttgcggtgtgtctattgtatgccaaaagagggactaccgtttttcccaacggatcgggtcctgtcgcaggatgaaattgtccaactgatcgagaattttgcggccatgggtgtgtctaaggtccgaatcaccggtggcgaaccactgctacggaccgatgtggtcgaaattgttcggcgtatcaaggcggtcgacgggattaacgatgtttcaatcacaactaatgggctatttttggcgaaattagctaagccactgaaagaagccggattggaccggttgaatattagtctggatacgtttaaagcggatcggtacaaaaaaattacgcggggcggtaatattcaacaggtgttagatggaatcgccgtggctagtaagttacatttcaaaaagatcaagttgaacattgttttgatcaaggggcaaaatgatgacgaagtcctagatttcttacattacaccaaggaccacgatgttaatgcgcgcttcattgagtttatgccgattgggaattcattaaagacctggcaaaaagaatacgtgggtttaaaaaacgtctttgatacttgtaaagacaacggcttagcctaccatccaatcgttttgcgtggtaacggaccgtctgataattatcaaattgaaggttatgagggaagtttcggtcttattcatccaatcagttctaagttttgtgaaaactgtaatcgattacgaattaccgccgacgggtacgttaaggcatgcttgtattggaatgaagaaatcgatatccggccagccattggtaatccagtagcgttccgcaaacttattcaaaaggcgttagataataagccgctcaatcatgaaatggccatgtccgaaactgaccggattattgacaaagccccaacgtggcggcatatgagtcagattggaggataagaaaatgactgtcgaagatgcacagacaagtacgcgttggcgggcctatttagcgttaggtctggcaacggtggcgatgatcgtttgtttcatgtcatggtccaactttgcaccattagctggagaactcgcaatcaagtttcacttgagcgtgtcgcaacggacgctgctactagcaacgccagtactacttgggtcaatcatgcgaattccagttgggattttgagtgatcggtatggcggtaaaaaggtttatctgatcttgatggccttcatcctgatcccactatttatgattacgaaggtccacacgtacggcatgttgttagttgctgccttgctcgttgggatggccggaacgtcctttgcggtcggggtatcgtatgcctcggtctggtttccaccagaaaagcaaggattagcattaggaatcgtcagtatggggaacatggggaatgcagtcgcggcgttgacgttgccatccatctccacctcgtatgggtttaacgcggtttactatttcttgatggtgttaacggtcatcttagccgttttattcgctatcttttgccgggaaatgccggtcgataagacgaagaccgtgactggcgcactggccgtcgccaaagaaagtagtacttggtatctgtcattattttatttcttaacgtttggactgtttgtttcattcaccaatttgaccccactgttcttggaagatattttccgcgtgccacaagtcacggcgggcttatatgccgcattattcgccggtctttgtaccgttgttcgaccaatcggtggcgcagcggctgataagtggcggccaatgcaaatgttgcagtggatttttatcggtatcaccgtctttgccgtgatcattaccttgaccttcagcaaccagtcgttgtttatcttcggcatcgtgggtgctggattaattgccggctttggtaacggggttatcttcaagatggtgccatacgtgtcaaaaggaaatactggtgcggttaccggctttgtcggcgctttaggtggtctcggtggtttcttcccaccactgctagtaggctggattcacacctggacgggtagttatcgacttgggatcgtactcttagcccttaccggattggtttgttggtatgcgctttggcgccggtttattcatggtgatgtccacattgtcaaataattgtaatcgattacaatttcgcgtcaattattagttattgacataaaacaccttataaaaatggtataattaaacaaataatggttagaaggagtgtggcagaatggcagatgggattggtgaaggcgcagaattttcacccattgaagatgcggtgatgaagtcgctggaggatgtgattgatcccgagttgggcattgatatggttaatcttgggttgatctatgatatccacgtggatgatgatgggaattgtgtcgtcacgatgacgttaacgaccatgggctgtccactgggtaacttgttagccgatcagattaatcaggcggtgatggggtcactggatgtgagatcgatctcgtttgggaaccagcttgggatatgagtaagatgagccgtttcgcgaaggtcgcgctaggtattcatggctaatcagtaattcagtaaggggttgcgcacgaatggatattaaaaagtttgtagcccgtcgtaaggccctgcaaatttcacaagttaaattatcagctggtatctgtacgcaggccacactcagcaaatttgaacggcgcggccgcgtgccgtcgctggccatcttagaaaagttgtgtgcgcgcctcggtctgaccgttgatgagctaaatgaggaccaggcgacttctgtgtccaaggtacggcaacaacttgatcatattgagcggcagttaatgatggaggactatcagtcggtcctacaagctttggatcagattacggtcagtgagattgcggcggttccgttgcggatgcaatattattatttgagcgggttgctaaaatctttgatcaatggcgccgtgagtgatgtttgctttgacttcgaccaaatcttagatgatttggatcagacgcatgaaacggtatttaccccgctagcgtacgtcggtttgggggtcatgtatagccgcttgtcagaattgaccaaagctcagttctactttgaaaaggtccgtcaagcggtcaagcaggctttggccaatggtgatgatcaggactatttgcggctgctgaccatgatcttttacacggctgaatacgaagcgactcgcgaggattttgcgacaagcaatcgcctcattgatgatggcgtgaccctttgttcagagcagcacgtcacctactacttgccacgactgaaatacctggcaacggccaatgccattgagcaacgccaatctgacgagcagattcaacaactgttaagtgagaccgttgcgtttgctcgaattaacaacaatcaagtggtggaggtcaaggccgcggccctgcggcgacgttatctgcaagcacgcaagcatgcttagacgggtgtagttcactcacaatcaacgggttaacctgaatttgaatcgctttaaacgaccatttctcagtcagctgagggatggtcgttttggttcatggttaacctatctgcggcgagcggtatcggtggcgtcaaaaaaagtgccgctcaatgcagcagcactttggactagcatgatcgaattatgatgacggaaactactgcggttgtgccgtcgccgtggccaaacgggtgagtgcctgttcgacgcgtttttgtaagtcagttggtaactgctgactgtctaagcgcgcttggtcgactaattcgctagccatggttaatgctggcgtgatgccaatcgtcaagacgcgttgctgggccgccacaaattggtcggccgttggtttatgggcttgatggaagaaatcgtaaaaatagccagggtcgtcttcgaaaccgaacaggagtggtaacggatagtttcccatcaagagccgttcgcgaaaatcagcaatttgttgagtcgtctgaacgtcggccagaatggttagtacgataccgattgattccccgattgcgcgtgcgaggccgcagacagccgggtcaaggccagccaagctagtagctaagtagccactcagactggttaatttggctggccgatccttcgtatccttcagaaaatccgcaatccgctctcgttgattaaagttcaaccggagtcgattgagattcgctaacggtaatgattgtgccgctgttaagagttcgtgtcgattggcaggcggcagcatggtcgtgtgactgaccgtccgaataaattgttggagtaagtactgactagcgtatgcgtgcgctttactcagagctaaatcattaatcgtgggtgtcggtgcaaaactcggtgcatctaaggttgctgccattgccaggacttcgatgattggcgtattcgccacggactgtcccggggtctcgaacagcgtatacactgcttgccgctggtgccgggcgagcgaatctgcggaatcgagtagctcgctaacggacgccggaatctgtttaatgaattgttgaaagtcgtcttctagggcgacgtcgtaatcaagtaacatccttatcgctcccgttagttttgaaattggtcaacttcacgtgccagttgttcagcaatcggcacaaaaatgtcgctgaagtatttgtccatatcaagtttagtggttgcatcttcaacagctgcttgtgcccgttggtaggcatcattacgcatgttgataattaataacttcttttgatgatggagatgcctggtgagttttttaccgtttgcaatatcgcgatatttctcaataaagtagtagagcgtctcgtaaaacgtattgtcgaggacccaaaataacgtgttgcgggagactttatcgttcatgacctgggcgaataaatcgtcacctaacaattcatttttgacgaatgcggctgacgatagaacgattgcttgaatttcatgcatatcggccatgaaggcgctgaaatgggtgagatccgcatcctttaagtcaaagccgagtttggctttacgggtcggtgcatccatcaatttgaagttgtcttggtactcgcgttgaatatcagtactgtcactgatcaggtcacgttcaatcccgacaagtaggctttgattggcctgaagatcagctttaacgaccgcccagatggccgcaaagtgagtgttgaagtcgtcaaacaagtcttgggtggtgccgacgatttgtttttgaatctgtcccttttcagtgtgcggggcaaattgaacgaccagtggaatcgcatcatccgcggtggcaaggccggtttgttcgcggcgttttgtttcgtatgcctttaattcgtcgaggctcaaaagtccgagtggcatgacgttgatttccccgttggttgtcatgatttgtagtgagaagggcgtgtcagcatgctgattcatcgtgaatgatttaaacgtttcgctgagtttactccgggtgccgagttcgtcttcggggtccgcatagaagccggacgtgtaaattgcgatgttatcatacttcgcgtttagcttttcttgaatatccatgggggcctcctatgcttgtggtcgggtaggtgtgttggcattatcggttgcggtcgtatcatcggcagtcgtaagggcttgcaatttttcagtaccggtatctgtcaaggttgcctttgtgaggtcgatgcttgcgagcgtatggctataattatcatcgagtcgcgcgtcattcaggtaaccgcgttcgactgctactgataccgtttgatacaacatggagttgggattgacctgtcttccttggtgaaaccgatgggtcgcaacatcgcgtaaaattcctaatagttcttcatcttgactaacattatgtgccattgtgtcaaactccttccaagtgcttttatcattagtttaccggaagagtagggtgctgggtattggggaaatgactatattatgagctgttgataaatgctccggctagccgaatcggtggtggcaaaaggttggtgtggtggacacaaaaaaacgaatcgggcggccgccgcgattcgttaataggccttggtagttttaagtcgctaccagctgggaaatgtgagcttgcgctaaggttacgtttaattagcctattacagtcttcagtgctgagtttcgatagctccagttgcgggaaactgtcaatacggtatcctagaagtcaatcaggtggtggtggatggcgtaccggattaaatcagcgcgattatttaacgctagtttgcgcatgatgttggctttgtgggcttcgactgttttagttgaaatgaatagcttagctgcgatttctttgttggagtagccgagtgccactaaagggaagacttcccgttcgcgttttgaaagaccgttatatccggtgaggttggtatcaacgccatttgaattgatctgttgaacgtcggatttagttatcacgatgttggtgtcaacgtattcttcgccgttcgcgactgttttcaaggctttcaataattcatcgtcagaagaactcttcataatgtatgatatggcaccattatgtaacgctttattgatatattcttgttcttcatgcattgagagaatcaggatacgaacatctggaaagtgttcgtggattcgctgagttgttatgagaccgctttctccaggaggcatacttaaatccatgacaagaatatctacgtcaccctgttcaacgcgcaagtaggttgacgttccgtctgcagcttcatcaatgacctcaaaattgggttgctggttaattaagtatgctaaccctgagcgaacaaccgcgtgatcatccgcaattaagacgtgatacatcgtaaacaactcctctaattataatatctaagttaaggtgttaacgtcatcgggaacttggcagtaacactggtgccggccccgggctgtgaatggagcgtaaaagtaccattaagtgctttgacccgttcattcatatttaacaggcctagtgagtgaccattgaaggtagcttgatctggaacgttaaaaccctgaccgtcatcgatgatctccaaagtaatgtaatgactatgtgcaactagtaagagattgatctcgttggcgtgggcgtgcttgagcgcgttattaattgattcttgaccgatgcgatagagcacgttttgcacgtctgtggcaagttgtgttggttcgtcgttaccggttaccgtaatcgttacaccggaattggcttgcaaacgtttagccaaagcccgtaacgcagctagcaaaccaaaattatcaagtactgaggggcgaatgtcgagtgccatgcccttaacttcggttaacgtgtcctctaattgggtttcaatcacgtgagtcaacgcactgatttcatcaggattggcatgttcagcgttgattcggcgaacacccatgatggcagaataaataccttgagcgatactgtcatgaagatcggcagagatttttttgcgttcttcttcatgagctcggttaacataggcgtttaactggcgctgctgggcaagttgatccatacgcttaatggtgccgcgacttttgagtgttaacgagaagacacgttcgtcagtgttgatgacgtgatagattaaaaagtaagcgagcgggtgtggtttatccttagccagtgtaatcggaattgaaatttccggcattaagttacgaatgacgcagtcaaaacaatcgtcagttgtattgaatttttgctggaccgcattgtccgcgatttgaaccaaataattaggatcaaagttgagttcggcttgtaaatcacgtgctaattgattactgatgactaactgatcgtccttaaaaatcaacaccgcatcggttgcttctgaaaaatattgttgaatccagtgatttgattctagcaaaaagtcggcctcccttcgccgaattaaaaagtggccagataatgggagagccgactgacggttttgtcggatacagtttgcgttgaacgataaccggcgagcaaaactccggtgacgagccgaaattcggttgtcacaatcggaattgctgctgcactagttaaacattctgcttgagcaattggcgtatacagaacatcagtataggtcgcattttgcaacgcattattccaaaaaggtttgccagttcgtaccactagcccggcaatgccgatgccactacgcaaaataatctttcgaaattgctcactccgattaccggcaacgtattgccaggtgatttgatggggagcttggttggcttgtaacgccacgccgacaaagtcaaaatcgctagtttggtagagctgatcaactaaatgttggtagttacgttgattggcattttcagctaaggtcactttttattcctcctttatcataccatgattgtaacggtctgaggccgatttacacattttaattttacagtgtcatatataattagaatattctatgattcacgatattggtctgccacgtcgagtttgaagttggaatttacgaattgatggtaatgttcatagtcttgacggactgcccgaatctgcatatcaagtttatctagtttatcatctttttcaagtgagcgcatttcttcattgactgaactaacttcgttttccagcattgtttgccggagtccgaggtcagtcagtgcaatttgcaataatttctggaaatcacgttcgttcatttctgctttacttagcattggtaagtgcctccatattgtttagattagtaaatgcttggctatctggaaaagtcaccggcagtccctgacacgtcgtcttgataaagtggctaactcgtaaatcgcctagcaataaatgagcgcgtaccatggtctgactggttcgcacatgacttaccaagtaatgatcctgtgttggtgtcgttgcgtaacaatctgtttgggtgactaaggtcgttaaaatggtggtagtgattaacggataatcaactgccaataacaggtaatcagtcagttctggtgaataattagtggctgcaaaaataccgctgaggggaccttggcgctcaaaaggaacttgatcggtcacgacgataacgtttgaactggttcggaactgctctgtcaagttagccacgttttgctgattagcactgacaatgacttgctcacatagcagttgtaacttggtaacggcaaggccaacgttattgagcggttggccaggtagctggacttgggctttgtcgcggccgaagcgctttgactgcccgccagcgaggacgattcccaacatgttcaggacttctttctcaagatttcggggtactagggtagacgaagtgaccactcttaccaccgtctttttccacgaggtgaatgttgctgattagcatgccacggtcgatggctttgcacatgtcataaatcgtgagcaaagtcacttgaacagcaagtaaggcctcgatttcaacaccggtgacgtgcttagtcttgacgagcgcgtcgacggtgatcgtatcttgatcgttgtcagtgaaatgaatgtcaacgccggtcagtggaatcaggtgacacattggaattaaactgctcgtttgtttagccgccatgatgccggcgacctgcgcaacagccaagacgtcgccttttttgatttgaccatcgtgaatacgttgcagggtggccgggtgcatggtgatttgaccagtggccgtggccacacggtgggtgacggctttgtcggtcacgtcaaccattttggcccggttttgatcgttaaagtgagtaagttgatcagtcattagttgtcgcagctcctttaaagtaagtttgtacaaaccagttgcaaatcgccgtcttcccgaccagggttgcgtcaggatggggtgtcagactggcaaaggcttgaatatttgtaaattgctgaaagtcgattgcgtgatcgtcggatcgtaacagcgctattttcggataggacgcgtgtttaaacccttctaacaagatcacgtcggtactcgtcggcaactgtgcgatcagctcgctgagagggaccggttgcacggctgtttgatggtaaaaagtcccattggcagactgcaagatgacgtcctgagcaccagcgcggctaaattgggccgtgtcggtaccgggggtatccatcgtactcgcgtgagcgtcgtgtttgagaacgctcacgtgtaagtggcgatcagtcagcagtctgaccaactcagtcgtgatgagtgtcttgccactctttttgtagccaattatttgaaaggtaagagccatgtttccacctcggcattgagttcaatcggacgattactgtgcggaattttaatcaaacacgtggttgtttgtaagttactcaaggcacctgagcggtcgggaccattcgggtacgtcgcgtactgaccgtgatcttctgtaaatgtggcgcgaaggatccggtcgaagccgttcgtcttatggtaaggtgcagctaaacgtgactggacctttttgatgcgactgggctgatggacaaagcggcgcaagaggggttcaacgtataggtagaaagcggtgaagcaagcacccggattgccagacaaggccatgacaagcgtgttatcctgaacaaacgccgtggtgacactacccggccgttgcttgattttattgaataagagttcgtcggcttgccgcgcagtatcgccaataaaatcgtagtcaccaactgagacaccgccgtctgtaatgacgatatcattttcagcaattgctttagttagggacgcttgcaatagcgcgttgtcgtcaactaattgttcaacgttggtgaccacgccaccattttcgcggacgaggtacgggatctgcacgccgttactattataaattttgccttcttggacaggttcacccggggccatcagttcgctaccagtcgtgatgacggcgacgcgaggctgccggtagacggtgactgtctggacgcctagtgcggtcaaaccggctaggccgcctggattaagttcggtgtccttttcaatcaaaacatcggcagtttgatattcttcaccaatttcagtgatgttagaatgcttttcgggaaccacgatgttgatgcggttgtcagccagttcgcgtgtcttttcgagcatcacgacgacgccagcatcgcttggaacgtccgcacccgtcatgatccgtacggcttcatctttgccaaggggttgatgaaaagttgatccagctgggatattaccgacgaccttgaattcgtgagggtagtcatggtcgtcttcgtgacgaatagcgaacccatcaactcctgagcgtcgaaagtgggggtacgcgaatggtgcggtgaccgtttcggctagaacccggtgattcgcctcggtgacggggattgtttccgtcttcgttggtaacgcaacttggttaattttagcctgggcttcggtaattgagatgggatatcttctagttaacataggcaaattactcctttgggttatttatgacgttcaaatagtaagtgttcaaattctggtaagatcagacggtcaagagccgtttggcaggcgttggttgatcctggtaagcagtaacagagctggttacgattattaaagcccgcttcagccttggatgccagggcgcgggtgccgatttccgcaaaagatagttcacggaaggcttccccaaaaccaggaatcatggttggcaataagggcgtcagtgctgtaatggtcacatcgcgttgcgcaatgccggtgccgccgttggtgataatcaggtctggccccagttgttcgaaggttagaaactgttgctgaatatcaacgatatcatcgataacgacgtgtcgcgccattacggtgaccccgtgatgttgtagccgttcggcaattagttttccggatttatcagtgtttagatcacgcgtatcactgactgttaaaatacaagcacgactcatttgatagggacctccaatacagattttagatgtaattgcaagcggttaaatactgcagtggccgcatccagatcgggaatgttatacaacatgactttgccattcttgaagatgctgattggtcgatcttcccacttgaaactaataaagctggcgtaacttttaatactgaactggcggtcaagcagccagtcagtaatagctgctaagtcgggtttctgagtgaaccgggcctgataagtcgcggtgccacagagtatctgaacgggattagttattggtgctgtggtcaagtcccagtcggtgcgttggcacgttggacagttgggattcttacgcacgtgaaaagtttgctgcgatagctgccagttatcgatcgtggtcagttgttcaaagtcaacgctagtgggtgctaccaagtaatggagggctagtgagacttgtaagccagctataatcgggacgagggcggtattgacgccgagtaagtcgcagtccgtttgctgtagcgcttcaaggttggggtagacgcagttcaagcaggcgtgctgccaggcacggatgggcatcactgtcccaaatgttccggcacaactagcgaagatatagtcgaagcgttcaacgagtgccgcacggttgattagaatccgagtgccatagttatccaaacaatccaagactaagtcgaacgttaaggtttgcaacaggtcgtcatctaaggcggcggggtaggccgtaatctcgacatggtgattgatggcctgtaagtgatttttagcggcatcgaccttcaaggcctgatcgcgaacgtctgcttcggtgaacaaagcttggcgttgtaagttggtcagtgataccgtatctggatcgacgagaatcaagtggcccacgccggcacgaacgagctgttcggcagcataactgccaagcgcgccgacgccgacgattaaaatcgtggcagcgttgatccggcgttgaccgtcgtgaccaatcaccgtgacgcgttcttggcggtcgtaacgattaagcatgtgctcatcttctttcatattaaattggtgtgttgtgcctcgctatttcgcctagtcactaccaggtatggcagtgaaacatgggccaaatgatgcgtgacaaattagtcacgtcaactttaaaaatataggtgtttccctagtcgaagtataacaaaacgcctgctaccatagatattagggaaatggcttacttttaattggagccgtttaattgtgataaaggaggtcttatcggtgaaaaaatcccgtttctttaaaaatgtcgaaaagttcaacggtacgttcactcagctggaagaaaatagccggcgatgggaacgcttgtatcgtgagcgttggtcccatgacaaagttgttcgtacgacgcacggggtcaattgtacgggttcgtgtagctggaacgtgtacgttaagcaaggcattatcacttgggaacatcaagcaactgattatccagaatgcggcgcaaacatgccgggctacgagccgcgggggtgtccacggggggcaagcttttcgtggtatgaatacagtccagtgcgaatcaaatatccatatattcgcggaaagctctggcaattatggactgaggctaagcaggcgcatgataacccgttagaagcttgggccagcattgtcgaggacccagctaaaactaaaatttataaatcggcgcgtggccatggtggcatggttcgggttcaccgaccagaggcactcgaattaatttctgccatgttgctctatacaatcaaaacatatggtccagaccggctggtcggctttacgccgattccggctatgtcaatgattagctatgcttccggggctcgctttatgtcgctgctcggtggtgagatgttgagcttctacgactggtatgcggacttgccaccggcttcaccacaaatctggggcgagcagaccgacgtgcctgaatcagcggactggtataacagtcagtatattatgatgtggggctccaacgtgccattgacgcggacaccggatgcgcactttatgactgaagcgcggtatcatggcgctaagattgtcgcggtcagtccggactacgctgaaaatgtcaagtttgcggacaactggttagccccgcatccgggctcagatgccgccttggcacaaggaatgacccacgttattttgcaagagttttatcagaataaacagacgcctgaatttttgaactatgccaaacagtatacggatttaccattcatggtcatcttgaagccgagtgcggctaattcaaatgattatacgtccgggcgtttcatgcgaatctctgatttacaaggcactgacacggtcgccaatgccgaatggaaaccggtcgtctatgatcgcaatcaagctaaggtcgtggttcccaatgggacgatcggtcagcgttgggaagccggtcagcagtggaatttgacactcaaagacgccgatggccaggcaattgatccgcagttgaatattacggcggaacaacaagtcacaattgactttccaacctttgacgctgacggaaacggggttctcaaacgacacgtgtcagtgcaaacgattacttttgcggatggcagtcaacagttggtgacgaccgtttacgagctgatgttggcccagtatgggattgatcagggcaaccatgatcaattggctgccagtggttatgatgatgcgaatagtcgttatacaccagcttggcaagagacggtgacgggtgttaaagctagtctagtcgttcaaattgcccgtgaattcgctcaaaatgcgctggatactggtggcaagacaatggtcatcatgggcgccggtatcaatcattggttcaattccgatatgacctatcgttcaattatcaataacttgatgttgtgcggctgtgaaggtgtatccggtggtggctgggcccactatgttggtcaagaaaagttgcggccccaagaaggctggggcgccattgcatttgccaatgactggcaagctggcggtgcccgtcaacaaaacgggacctcgtttttctacttcgcatccgatcagtggaaatatgatgaattggataatgaagcgcagaagtcacccgttagtgcgtccaagcatgcttatgaacacgcggctgattataaccagttggcgatccgactgggctggctaccgtcctacccacaattcgatcgcagttcgttagcctttgctaaggaatatcaatcgacagatatcaatgaaatttcacagcacgttgtcgatgaactcaagagcggtcagttacactttgctgctgagaatccagacgccaaccagaatcaacccaagggtctctttatttggcgttcgaacctcttcacatcgtctggtaaggggcaagaatactttatgaaacatttgttgggcgctgaaaatggcctgttagcgaagtctaatagccgttgtcaacctgaagaaatggtttggaatgatgatacggtcactggcaaattagatttggtcatcgatgtggacttccggatggtggcgacaccgatgtattcagacgtggtcttaccagctgcaacgtggtatgaaaaggctgacttatcctcaactgatatgcatccgtttatccacccgttcaacgcagcaattaatccgatgtgggaatccaagagtgactggcaacaatttaagaccctggcgaagactttctcaacgatggctaaaaagtattatccagaaccgcagtatgatttaaagacgcaaccgctcggccacgattccaagggcgaaattagtcagccactgggtgaaattcgtgattggaagaagggggaaatcgacgcgattcctggacagaccatgcccactttgtcattaatcaaacgggattacactcaggtttatgacaagtacattgcgttaggaccgaacgcgcgtggtaaggaaggtggcctgggcttcagttatgatgtcacgactgaatacgatgagcttaaggatattttaggggtgtatgatcggggtgtgaatgctggttgcccaaagttagatcaagataaacgcgttgtcgatgccatcttgcacatctcgagtacgtccaacgggcacgttgccaaaaaggcttgggctaacgcggaaacggtcactggccggtctttgagtgatatcagtgctggtcgcactgaagaacaaatgtccttcaagagtattacggttcaaccggcggaggcgattccaacgccaattttcacctcggccaagcatgatggtgatcgttactcaccatttaccgtcaatattgaacggctagtaccatttcgtactttgactggccggcaacagttctacctggatcatgaaatcttccaggaatacggggaaagtttggccaattataagccaacactgccaccacaagttatggcacctggtgatacggaaatcgcaccggccgataatgaactgacattgcggtacatgacgccacatggtaagtggaatatccacacgatgtattatgacaatcttgaaatgttgacgttattccggggcgggccgaatgtttggctcagtccagttgacgctgataaagccggcatcaaagataacgattggttggaaatctacaaccgtaacggggtcgtgactgcccgggcggttgtttcccatcggatgccagcgggggccatgtacatgtatcatgcgcaagacatggaaatccaagaaccgttgtcaacgattacaggtaatcggggtggctcgcacaatgcgccaacccaaattcatgtgaaaccaacccaaatggtcggtggttatggtcagttgagttatggtttcaattattatggcccaatcggtaatcaacgggacctgtacgtgaacgtacggaagttaaagaaggtgaactggaatgaagattaaagcacaaattgggatggtcttaaaccttgataagtgtattggttgccatacctgttcggtcacttgtaaaaatacttggaccaatcgtcctggggcagaatacatgtggtttaacaatgtcgagaccaaacccggtgtcggctacccgaaacgctgggaagatgaagatcactataaaggtggttgggagttgaacagtaaaggtaaacttcaactccgagcaggtaataaggtcaataagatcgcactcggaaagattttttatcaacctgatatgccagaattggacgactattatgaaccatggacgtatgattaccaaaccttattcggacctgaaaaggcccatcaaccagttgcacgcgcgacgtcgcagattactggattaaagatggatcttaagacgggccccaactgggatgatgatttagcaggatcacctgaatatttcaaagcagacccgaacatggaaaagatagagactgatatcaaagcgaactttgaacaggccttcatgatgtacctcccacgtctatgtgaacattgcttgaacgcaccatgcgtggcgtcatgtccttctggggcgatgtataagcgtgatgaagacggtatcgtcttggttgatcaagaacggtgccgcggctggcgtttttgtatgacgggttgcccttataagaaggtctacttcaactggaagactcataaggctgaaaaatgcacgttctgttatccacggatcgaagaaggtgaaccgactgtctgtgccgagacttgtgtcggtcggatccggtatatcggcgccatgttatatgacgctgatcgggtcgaagaagcggccgaaacgcctgaggaagaccaattataccaagcacagttagatttgttcttggaccccaatgatccagacatcattgaacaagcgttggcggatggcatctctgaagaaatgttggaagctgctcagaattcgccgatttaccggatggccgtcgaagaaaagatcgcttttccgcttcatcctgaatatcggacgatgcccatggtttggtacatcccaccattgtcaccagtcatgaattattttgagggccgcgattcgatcaaagatcctgagatgattttcccaggaatcgatgagatgcgcattccagttgattatttggctagtttacttacgggtggcaacgttccggcaatcaagggtgccctctacaagttagccatgatgcggctgtacatgcgggctaagaccggtggcaaggacttcgacgcggctaaattacaacgcgttggcttgactgagaacacggcgacatcactttatcgcttgctggcgattgccaagtacgaagaccgttttgtgattccacaaaatcacaaagaacaagtggaagatgcccagagtgaacagggcggcttaggttatgacgaatgtgctggctgcgcgttagcaccacagcatggcagtatgttcaagaaagccgaagctggtgaatcgaccaatcaaatttacgcagaaagtttctacgggggggatttggcgtgattaattttaaacaattaacaacgatgcaacccgcgctagttactttgtcgcggttgatcgactatcctgatgagatgacgttcgttacggctacccgtcagaatatcgtaacgggctatccggcgactgctcaaaaagccaaattgttggcggcattcgatgaactagccgcccaaccgttattagcgcaacaggcccactatgctggcttatttgagatgaacaagcgctacaccctctatatgagtttttacaagatgacagattcccgggaacgggggaccgttttggcgaagctcaagatgatgtatgaaatgtttgggctgacgacggttagtagtgagttagcggacttcctgccgctgttgctggaatttctagcgtacggtcactttgcggacgatccgcggcaacaggatatcaagctggcttttcaagttattgaagatggcacctatacgatgttacaaaatgcagcggccgaattggatgatccatacttccggttgttacaagtcgtacgggcggaattacggacgtgtgtggaaacgggggtcgcggcatcatgaaagatttcttttccgtagtactgtgggtgatctacccgtatgccatgttattatcgttcttcgtggggacgtttgtgcggctgaaattttatccggctggcgtcacggcagtttccagtgaaatgctggagaagaaaaaactgatgattggggccatcactttccacgttggaatcattttagccttttttgggcatatcttagggattctgattccgaaagcttttacggactttttgggaatttcagatgagatgtaccatatgttcggttccttaatgatggggactggggccggagttttggcccttgccgggatgattatcctgacgtaccggcggtttaccaatgtacgggtgtttgtcaccagttcttggagcgatttaatggtcaacgtggccttgttgattacgatcattttaggattggcttcaacgctatccggtcctttacacccggcgtttgactaccggacaacactctcagtgtgggcgcgctcattgttctatctccaaccaaagtggtggttgatggctacggtgccgtggatttacaagacgcacgttatttgcggcttagcaattttcggtttcttcccatacacgcggctgattcacgcgattgcaattccttaccagtacttctatcggcgttacatcgtttatcggcggcggccacgagtttagtgaatcgttgcgaactttaagcaaaaatggtttttacggcacggatgggtgcggtgaaggccattttttagttgcgccgatttgctctggtggttcaagctgcaggttgactgtcgaaatcgcgggcatgatcagtggtaatttggaacgcacagatacaactccaaggggatatgtgccaattcgttttggggtgattccctaataggatttgcagtggtggggtgctatgctgaatttaatgaagtgaatggtgaaaggagtttcgtcatggctaagtttaactttacgctgaacgctgcgcggatggacgcgagtgggcactatgattttcaaaatgtgtttgaatttccagattttattgaaatgcggccaactttgcgagcagcggtacgcacggtggctcgggaggcttttgatcagcccgtattgccggtgaaggtggaacggatgacgacgtcgctggaggaacaattagagcgtgagacgcgcaaatatgagcggcaagtcggtgtttatgacaatcagaagagtgaacgcaatcagcttgtccggttattcacgcagatcttacaggtcatcagccgaactgacgaaatcactgaagaacttgaagatattatctatgccgtcaatcaaactcgtctgagtctgattgggctaccagcacttgaaggtactggcgaactatacgatgccgaccgcgatcgtgaactgattgcggggacgtactattattttgtgacccatctgttagtacggccgtatttacgcgatatccggggtgacttggttccagagaacgtcacggcggcgggtcgccacttagtcgtccggatgaccacgtatgcttaccgtgattgggacgcgtacctagtccatgaatacgatgaacaacatctgatcaaaaacgagaaggggctgacgaatgcagcgtattatgacaagctggaagcggtcgaattaaagtatgctgatcatatttatgccgaggtgttggccgacacttatcaggagtttgtgaaggtgttagtccccaatcagctagaacgttttgaaatcatgtcaagtgacttgcggccgttattagctaaaaatccggggttgcgcattcgattggccgccattgtcaatcggcattttaagttggaccaggatggctatgaacacgtgatggacgcgcccctgcaagaaatcaaacaaaaataccaattttatcgtgaaaactttagttgaggaggcagttgctgatgactgtagatgcacagttaggtaccgaggcgtttgaaaaagtgatctttatgctcgacgtcgtcccgaccaaggacaatatccaggaatttgccatgcaaggtaacttgtacccagaaccaatcgatgagaccgcgtgggcgttgccaggctacctgtcagatgactacaatattttcttagtcttcgccccgaacgtcttgaatcattggaccgtgacgtgcgcggaagtgactattgaaaacgggcacgacatcactgaaatgagcaacgttgtcccgaccggcactggcatgaatgcggtggcccatgccagtaaggcgggggccatcgaactattggcctattttaagaccttggaagccaacggactaggacactttgatgatgaagtctggcagtatgtgtagcgcgaaggttggcaaaaatttgtgaattgtgatagcaaaatagcgtagttgttcggtagtcgtaatgggctgattattgaacaactattttttgatatatttaataaacaaataaaaatcgttggtaatcaaatattgattatcgtttatcgatatgatatcttaatggtaagaatacgggggtgtaaattatgtcaagaatgatgaagatgggaacgggaacgttgagggtgattttgtggtttgcatcaatattaatttggtttagcatttttgtcccgattgaatatctcgttaattatttttcgggcgaaacgacaaattatattttacacagtgatgactttatgatgccgattaagactcatgttgcgagtacgaacgcgattgctagttttccgtcaggactttatacgacgttaatgattattggttatattctgatgctagttggcgtatttataactattcaggcagtttcagcgattgtcaggcatattcaggaacaagactatttttcaactgaaaatagtcaacagatgaatcgaatcgtaaaaggtcagatatggatactgggctcgtcgttgttaatggcttgtgcaaaccaattgacggttagttggctatatcggattagtcaatttggccttggatgggacaacttgctgagcgcttttgttgacctaattatctttgccttaattgctatgatttacactcgcgccgttaacatgaagactgagagtgatttaactatttaagagggagggttgtcgtaatgatcaggattaccttgaatgtcgtcatggcacaacgtaacatgacgaccagtgaattagctaaacgagtcggtattacgccaaccaatatttcaattttaaagactggcaaggccaaggcgattcgattcagtacattagagaagatttgtgccgtcctggattgtcagccgggtgacattattagttacgttgctgataagtagtggttgtcagacataagaaattcttattaaattcacaggcacaaactattttaccttctttgactaatttgatagacttaagataagaaagttgaggtgactgattgagatggctagtcataggcagatgattgacaaactagtgtggtgttgttactagcgcagtccgcgttagtaacgatgcacaaactcaatttttaatcttaactcggaaaaagtaacgagtagtcaatttttaggtgaaagagggattctatgaacaattttcaaaatgacccacaaccacggaccatcaacacacaagttggcctccgtagtttcctaactaaaatgtatgggtttatgacaatcgccgtgttagtttcggcctttaccgtttacttagcgatgaccacgttccaagcacaaattaatgccgccttttcacaacacccattcatcttcttgatgatcttcattgtcagcatgtttgtgatgattggtgggattcaagtcaacgcgacacgcaatccagcgatgagcttcaccttactgatgctctttgccatcatctttggggttgaaatgtcagtgaccttgtccttatacacgggtgccgttatcaccggggcgttcgttgcggctggcgccgtatttgcgaccatggcggtgattgggacgacgactaagcgtgatatttcacggattgggacgcacttgattgcagctttaatcgggttgtttgtcgcttcactggtcaatatgttcttacaaagtgccatgattagttacatcttttcatacattggtgtattgatcttcgccggcttatccatgtgggacgctaaccggatgcgcaacatgtatttacaatatggtgaccaggtttcatcgactggtttggccgttactggggccttacaattatacttggacttcgttaacttgttcctctactttgtccaaattttcggtggctcaagccgcgactaatcattaagataattatgaaggattatgaccaaggtgtcataatccttttaatttatcggaaatgagttatttcacgggttttcggtggaccgaactcccgttttacttaattgtttggtacaattataagggtaaataattagtcgttcagcctgtactgacaggcactgcgaatcagattgccgaccgagtggtattaatggtctgagtaacggatttttcataaaaatgatgatttaaattaagagatggggagcaaactaatggcaaaaaaattattactgattgatggtaacagtgtggcatttcgggcgttctttgcgttgcatagtcaactggaacggttcgtaaatccagacggcctgcataccaacgccatttatggcttcaacacaatgcttgaccacatgatcaaggcagtcgaacccacggatatgttagtggcttttgatgcgggtaagaccacgtttcgaacagccatgtacgataattacaagggtggccgggctaagacgcccagtgagttttctgaacaaatgccgtatatcaaacagctattagacgcatatggtatcaaacattatgaattaaaagactacgaagccgatgacattattggtacactggccggtcaagcggatcaaaccggctacaccacaacggtcgtcactggtgaccgtgatttgacgcagttgacgaccgagcataccacggtggccgtgaccgttaaaggtgtttctgaagtggaacgctatacgccggcgcacgttgaagaaaagctgggcatcacaccggcacaaattattgatatgaaggggttgacaggtgatacctcggataactatccgggtgtcaccaaggttggtgagaagaccgcccttaaattactcaaacagtatggtacgatggaaggcatttatgaaaacatcgatgccatgaagcagagcaagatgaaggaacatctgattgaggatcgcgaacaagcggcgcaagctaaggtgctagcaacaatcaagcgggatgcgccgattgatgttcaattggctgatttatcctatgatggcccggatcttgaccagctggccgcgttttatcagaagatggactttcaatcatttttgaagaaattacacctacagtcggacgaaccagcaacgcccattgattataccgtcttgacgaaagctaacctgacggaattgcaacaatttaccgaccacgtggacttttacttggagatgccaacgccaaactaccacacgtcggcctttgctggctttgccatcggagcggatgatcactggtatatcagtcgggatgtggaattattaatgcaaccgactgtggctgacctcttgagtagcacaacgattaccaaggatgtttttgatatgaaacgcacgacggtcgggcttaatcgtttgggtattcagctaggtaaagtcgattttgatctcttactcgtttcatacttattagatacaaatgataacagtaacgacttgggaagtttagctgagcaacacgggtacactgacttgccgagtgacgagaccgtttatggtaagggcgttaagcgtgccattcctgaagatgatgatgtctactttagtcatctcgcccggaaattggccgcgatcgctagtttgaagccacagttattaaaggaattggcagccaatgagcaggatcaactttacgatgatattgaaaaaccgatggccaatgtcttagctcagatggaaatcgccggcattacggtcgacagcagtcgacttaaagccatgggcagtcagtttacagaacggttgagtgaaattgaacagacgatttatcaagaagccggtgaagagttcaatattaattcacctaagcaactaggtcacatcttgtttgaagaaatgaaattacccgtaatcaagaagaccaagacagggtattctaccgccgtagacgttctagaaaagttagcaccggaagcaccaatcgtcgctaatattttacaatatcgtcagatttcgaagattcaatcgacctacgttgtcggtttgttagatgccattcattctgctgatcaaaaagtgcatacgcgctacttgcaaacgttgacccaaaccggccgattgtcgtccgttgatccaaacttacaaaacattccggtgcgcttggaagaaggacgtaagattcgacaagcctttgttcctagtcatgaaggttggcagattttctcgtctgattattcgcaaatcgaattacgggttctcgcgcatattactgatgatgaaaatatgcaggccgcttttaaagcgggtgatgatattcatgccgcaacggccatgcgaatctttcatttgaactcagctgaagaggtgacgccaaatattcgacggcaagccaaggcggttaactttggaatcgtctatggaattagtgattacggcttgtcacaaaatatcggcattacgcgtaaacaggctcgcagctttattgacgcttacttcaaagaatatccgggtgtcaaaaagtatatggatgaaattgtccaaacggcgaaaaaacaaggttatgtggaaaccatttcacatcgacgccggtacttgccagatattaattccaagagcttcaaccaacgctcattcgctgaacggacagccatgaatacccccatccaagggagtgcggctgatattatcaagattgcgatgattaagatgcaagataagttacaggctgcgggtttgaaagcaaccatgctgttacaagttcatgatgaattgatttttgaagcgccaaaagaagaaattccagttttagaaaaattagtgccaagcgtgatggattccgccgtacagttagccgtaccgttaaaggttgagagccactacggtgatacttggtacgatgcaaaatagggggaaccaccatgcctgaattacctgaagttgaaactgttcgtcgcggcttaaatcgtctggttagcggggcaacgattgctagtatcgaggttttttggccgaagattattaataatgatgtcgatagtttcaaacagcgtttagccaaccaaacgatccagaccattgatcggcgggggaagtatttgttgtttcgctttagcaatggtctgacgatggtgtcgcatttgcggatggaaggcaagtataatgttgtaccgcgtggtgaagatcaaggtaaacacacgcacgtgatcttccatctgaccgatgatcgtgatttgctgtacaacgatacgcgtaagttcgggcgaatgacgctcgtgccgaccggtgaagaaaacacggtggcgggattgcggacaattggcccggaacccgttgctgaacagttaacactggcttatatgacggccacttttggcaagtcgaaaaagatgattaagccactattgttggatcaaagtaagattgcgggcattgggaatatttacgcggacgaaacgctatggatgagtaagattcatccaatgcggcctgctaattcactaactactgatgagattgctacattgcgccaaaacattattgatgaaatggcgatggcaattaaaggtcacggcaccactgttcattcattttcaacggcatttggtgaggccggtcagtttcaaaatcacttacacgtctatggtcgtgaaggggaaccttgcgaacggtgtggcacaattattgagaaaatcaaagtggcacagcgagggacccatttttgcccgttagaacaacggttgtaggtgatcaagatgacaaagttgattggattgactggtggcattgccactggtaagtcgactgtttctaagctgctggcaactaagttaccaatcgttgatgcggataaaatcgcgtggcagattgaagggccaggccaaccgacgacccaaaaaattgtggcgcactttggtcagcaagcagtgctggcagacgggcggctgaatcggccatggcttggccagttggtttttaacgatgctcaagctttacaagccttaaccgcaattacacggttaccgattcagtacgcgatgttcgaagcgattgtcgcggcgaaccagcaacagccagacgcaattattttagatgtgccgttgttatttgaaagtggctggcaacacgtttgtgatcaagtgttggtcgtgacggcaccaccagccgtagtattgcagcggttaatggcacgtaaccacttatcgcaacaggcggctcaggcacgaattgacagccaaatgccacttgcacagaaggtcgcaagggctgacgttgtcattgataacggggccaacattgataaaactaaagcagccgtgttaaaatggctgaaaactattactaaataaagaaaaactgattgttagttgttacaaggggtgagaagtctatgcaatgtccacattgtcatcataatggctcccgcgtggttgacagtcgaccaactgatgatggtcgcgtgattcgacggcgccgggaatgcgaaaactgtggattccggttcacaacatttgaacgggtcgaagccacgccattattagtcattaagaaaaatggtgcccgcgaagaattcaatcgtgaaaaagtcttgcgcggaattattcgctcggccgagaaacgacccgttagcatggaaaccatgacgggcgtcgttgatgatgttgaaaataaggtccggtcactgggcgaaaatgaaatttcaagccaagttatcggcgagtatgtcatggagcaattggcagatattgacgaaatttcgtacattcgttttgccagtgtttaccggcaattcaaggatatgcacgtcttcttgaatgaactccaagatatgatggagcgtgataaggtcaaactggcaaaaccgtcagcgaagacgacccacgcacctaaacgaaaaaaagattagtgaaaaagaatggtgaacaacatgccaaatgatgaacccttaacacccaaaactgggttagtggtcccgcaagcaccagcgctcagtgcggcgcaacaagctgtattggcggaattatacttgccactgatggggccattggcatatagcttgtacgcggcgttacgtagcttacagagtagcgagaatgagctgagcaatcgacgcagtcacgcggaactgcttggcatcctaaatgtggacttgccgacggtgttagcggctcggcgtaaacttgaagcaactggcttgttgcgcagctattatcaacaagatgaattgggtgccatgtacatttatcaattacaagcaccattactggcgttacaattctttgcggatgatctattgagtgtcctattgttagatacggtcggtgagttacgttatcaacaacttgctggcgattttgcagcacagccgattgacttgacggctgccaaagacgtgacggcaaatatcttagatgtgtttcacgttgatagtcaaaaagttacgacgccacctctttcagtgcaaaaggtgcgcgcccaattggcggccaatgaaccggccgaggatcactcgcccgtgctcagtgacgatgactttgactggcaactgttggggcaaattttgaagcagaactatgttgatctcaaacaggttgcgagttcacggcaactgatcattacggaaagtcgggtctacggcatcagtgagattgagatggcgaagttaatcagtgaagtggctagtttaacaacgggtcagtttgatgaaaatcaattgaaattattgattgcgcggcgctatgaacggcccgcagtttcgagtcagcaggtcgctacggaagcaacggttgcaacgacgaccactaaggataacaaggcttcagcacagctctcaacggctgagcagcaactcgtgacgtatgctaagcagacagcgccgtatgactttttatcagctttgaagcaggagaaacatggttttgtgacaagcggtgagaaccggctagttcatgatttaattggtcggggggtattacccaatgccgtcatcaacatggtgatctactacttattgcaaaatcgggagttagctgcccttaatcgtaatttgctagaaacagtcgccaatgattggcaacaacacggcattacgacgccggaagcggctttgatgtatttgaagcaacgtaaacagccgaaatcaacaccaacacggcgcaagaacaatcgaccgacgcgtaaggagattatgccaaagtgggcccaacaacagcaacagactgagagtggtaagcaaccagctcagaccggtaaacaaattactgctgcccaacgcaaacagcttgctgatcgactagcaaagcttgagacaaattcggaaaaggaggactaaaacatggagaatatctcagaaacactccggacgttaatgaatcggaaaaacttgaatcatcggtatgaggcgttaatgacagctgtgtaccaagatccagatgttcgccagtttttagctgctcatcaaaacgaattatcttcggatgcgctagaacgttcagcggctaaattatatgaattttgtgaagagaaacgtaaaattgcgcggcacgagccaactcaagcacctgggtatcagccgacattagtgatgagtaatcacttgattgacattgcttatcagccaacaccacaaatgcaagaacagcaagctgctcacgcattgcaacagcgggttcgatcaatcagcatgccgaaaaatattcagacggcggacttaaagacgtatgatcaagatggtgaccgggcgacagcattaatggcagcacttgattttattgatgcctatacacaagcgcccaagcgttttcaccgtggcttgtatctctacggctcatttggtgtcggtaaaacttatttactcggtgggatggcgaacgcgttggcagctaagggtttcaatacgaccttgattcattttccgagttttgcggtcgagatgaagcgctcgattagtaacaatacgtcggcggataaggtcgatgcgattaaacgggcaccgattctcatgattgatgatatcggtgcggatgcttcgtcgacttggattcgggacgatgtgctcggggttattctggagtatcgaatgcaggaggaactgccaacttgtttctcgtctaatttttcgatgcaagaattgcaagatggttatttgacgctctcacaaaagggtgatgaagaaccagtcaaagcgcagcgaatcatgcaacgggtacgttaccttgcgagtgagattgagatggtcggtcgtaatcgacgactcaatcccgatgcttaaaatcaagagttgacttttagtttaaaagtggtttaatgaaaacagatgcaaaagacacgctttgtttaccatggattgcagagaccaagaccttgttctggaagtcttggaccgggtttacgaagataccacttttgtgaacatgctcaattgagccggaacgcttccgttattagcgctaatgagtcagtgtctttgatgacactgaaaaatcgggtggaaccacgtcaatgacgtccctaatgctagttcagtctggcattagggacttttttgtcgtcccggcgcggtgttttggtgagtgggtaaattttaaggagagtgtcaagtatatggcaagtattaatgttaagttcccagatggtgctgaaaagcaatttgatgccggcgtaacgacggaagcaattgcaaagtcaattagtccttcattggctaaacggtcggttgctggtaagttcaacgatcagatcgtggactatcgccaaccactgacaaccgatggtagtatcgaaattatcgctgctgatagtgaagacggcctcaatgttttacggcaaacggctgcccaagtattagctaacgcggttaaacaattattccctaacattcattttgggagtggtgaagggaatgccaacggtttcttctttgataccgacaatcctgacgaagacggtaaacaagtcagtgaagatgatttggaagccatcagtgataagatggctgcaattatcaaacaagatttaccaatcgaacgcgaagtcttatcaaaggctgacgctttagctttagttggtgacaacccttaccaacaagacttagttaacgaacgtgccgctgccaacaatgatcaagtcgttgtttacaagcaaggggacttcgttgatttatctgacggtgcccaattagcttcaacggggaaagtcaaggtcttcaagttattatccgttgccggtgcatactggcaaggtaagtccagcaatccaatgttacaacgaatctacgggacggccttcttaaagcaaaaagacttagatgctgacctcaagcggcgtcaagaagcccgcgaacgtgatcaccgggtcattggtaacgaattagacttattcttcgttgatcctaaggtcgggaatggcttgccttactggatgccaaatggtgcaacgattcgtcgccaaatcgaacgttacattatcgacaaggaagttgcaaatggctaccaacatgtatacacgccagttttagctaacttggacgtttacaagcaatctggtcactgggaccactaccgtgaggacatgttcccaccaatggacatgggtgacggcgaacaattggaattacggccgatgaactgcccatcacatatccagatttacaaccatcacattcgctcataccgtgaattaccattgcggatcgctgaactcggcatgatgcaccgttacgaaaagtctggcgccttaactggattatcacgggttcgtgaaatgactttgaacgatggtcataccttcgttgcgttggatcaaattgaagaagaattcaaaaaaatcttgagtttgatggttgaagtatacgaagactttgacatttctgattaccggttccgtttgagctaccgtgatcctgaaaacaaggaaaagtacttcgatgatgacgctatgtgggaacgcagtcaaaagatgttgaagtccgctatggatgatatgggcttggattacttcgaagctgaaggtgaagctgctttctatggtcctaagttggatgttcaaacgaagacggcccttggtggtgaagaaaccttatcaactatccaattggacttcttgttaccagaacgctttgacttgaagtacgttggtgctgatggtgaagaacatcgtccagttatgattcaccgtggtcttgtttcaacgatggaacggttcgtcgcttacttaactgaaatttacaagggtgctttcccaacctggttagcacctaagcaagtaacaatcatcccagttaacaatggtgcgcacggtgcctacgctgaaaccgttcgtcgtcgtttggcagctgaaggtgttcgggtaagtatcgatgaccgtaacgaaaagatgggttacaagattcgcgaatcacaaacgaagaaggttccatacttgttagttgtcggtgatcaagaagttgctaacgggagtgtttcagttcggaagtacggtgaagaacggactgaatccgaagccgttgacatgttcattggtgccatcacgcaagaaatcaagcattacagtcgtggtgcaagcaaataattaacagccaatggcatcaatattgattgatgggttgacaagggccgtggttcttgttaatatattggagttgagaaaaaaagcagaagcacccgcttctcgccttggtgaccagagtcatcgggcagatgaacgatgaattgattcccattaacggggttgagcgggcgtactatgcgcccgctctttttgtgaatttctctaaaatatttcggaggtgaattaccatagctaaagattcaatggttaatgacggcatccgtgctcgcgaagtacgtttgatcgccagcgatggtgaacaattaggtgtcaagtcacgacaagaagcaatgcagattgctgaagacgctagtttagatctagtattggttgcgccgaaagcgaaaccacccgtggccagaattatggattatgggaagtaccgtttcgagcaacaaaagaaggatcgggaagcccgtaagaagcaaaaagtggtcagcatcaaagaggtccgcttgagcccagctatcgacaccaatgactttaacacgaagctgaaacatgctgaaaagttcttgtcaaaaggtgacaaggttcgcgtctccatccggtttaagggccgcgctattacccataaggacattggtcgccaagtcttaaatcgaatgattgaagctactaaggaattttctacggtcgaagcctatcctaagatggatggtcggagtatgttcctagtactagcaccaaaaacagataagtaatttctaggaggattattgattatgccaaaacaaaagacaaaccgcgctgctgcaaagcgtttcaaggtaactgctaagggtaagattaagagcgccaacgcttttactagtcatcgtttccatggtaagactaagaaacaacgtcgccaattacgtggtacggctattatcgaaaagccaatggtcaagacataccacaagttattacaaaaataattcacaacgttttagttaaatctaggaggaaataacatggctcgagtaaaaggtggaactgtaacacgcaaacgtcgcaaacggattttaaaattagctaagggttaccgtggtgctaagcacatccaatttaaggttgctaaggaccaagtaatgaagtcatacctatacgccttccgcgatcgtcgccggcgtaagagtgacttccgtcgtctttggattgcccggatcaacgcggcagcccggatcaacgacatcagctacagtcaattaatgcacggtttaaagttagctaacgttgacgttaaccgtaagatgttagctgatttagctgttaacgatgctgatgctttcaaggcattggttgacactgctaaaaaggcacttgcttaatttaaaacttaattagggcttgctctaatgtttgaacgaccgtcatcctgtatgggtggcggccgttttttttgacatttaaaaaagcgttatccagacaatgtaattatcggtttctttaaaaaatacggtggtgttttgttaatagtatgcttcatttacattttatcgcaatttggattgccggttaccgcaatcgatgttccaatagttcttggaatttggggtatttcggttgttgtgttgagacacaagcaaaagtaggacgaactgctaccagtctgttgcttatggagtcatgataactcatggctctttctggtttttatctaatattgacgtccctgataacgtactgtcatcaaaggacttcatggttcagaccctgttttttggtcattccatatgagcacctaattggcggtaaaagtattaaaaatcagtggttgatcaactatcggcattcgtgcgctttagaaattaaaatggcagataacccggagcgctgcgcacttcaatacagtttttaccaacatctcaatcaccgcgacggctaatcagatcaaaaaaagcgctatccaaatgcacttatgcattcagatggcgcttacgattcgtcatcagccggaaatcactttttcagcaacaacatcattcagaattttcttggttgctgaatgatttatgcactcgctgtgacagcaactttgaaataatgtggattactcgttgctagttagacttaattcattcatgaaagtcaataagagtttggcataactgggatggtcggtgttgctcttaacttcttgctgcatttccgttagattatcagtgactacaccggtgacgcccatgaacatcatttgatccatttggtccgtattatcaatgtcccaggcgtaaaccgtcttgtggttgcggtcagccttgtcgacgaattggtcgtttaacgtggtgacctccatggtgtagccgttcgcaactgtatgcgggaacgtgagattataaggcaagatgtaactaacgaattgtttttgatctaagcgtttcaagtcacgcatgactttgaaactaagcgtatggacttggtcatgatgagccagtagggtcgcaccataacgatcgatgaaccgtttagtatcggcggcggtgtaagccgagctggtcttgatttcgactaatagtttttgatgatgcttgtgagccgctttcaggtaagcatcgaaacttggaatctttgcctgatagccattttcacgaacagtaattttttctagttgttttaatgttaattgagatggctttttcttaacgccagctaaggcttttaaggttggatcatgcatgacaacgaattgatggtccttggtgacttggatgtccatctcaacgtaatccggatgttccttgctggtcttgatcagtgcaggaattgtgttttgcacgccgttaccgttatcgacgccgcggtgggaaatcatgattggcttggtaatcactagtccatttaagtagactaaattaacggcaactagcaaacttgtcgctaacagcaagccaattgcaacactcgcccgggtcaatttgcgcaaccgtggtgcctcgttaaagtattgcggttgttggcggaggagtgtaaagtcttgacgatagcaaacaataattaacatcatgaagatggccgtggtataacaaataataatttcggtgattgcttccatgataaagagattaacagtggcagcggccatggcaaaacttgttttatcgaattgaagctgggcgacgtaaatcaacgtataaatggtcgtgacgatcagaaaaatcataaataaggtcacaatcatggtccataagtagcgccaaagatggtggcgcgtttgttgccaactacgagtaacggccgttttacatggaagccgatcgacaatcattagcggtaataggctaattaggcgaattccaaggtaaccagccagcaagtagaagcaccccaagccgagcgtcatccacgggttttccatgagatagctgacaatgaaggctggaattttggccttgttgagtaatggtgttgtaaagatgaaacttccaaatggcaaaatcacaataaagtagccaataaagaataagaaagtgctgggtgaggtgccagtcagactagtgaccgttgaccgcaagaccgcgcgtacagtttgtggtcggccacgaaagatattcataatacccagtagcagaaacgcaaattgccaataaactaaaataataatggctaataagatcgccaccataccgagtgcggccagtggttggtgaataataatactaccgatattcgtgtacgagacataactgacccgttgccacttgagtaacatttctagcacccaattaaaaaaaggaattgctaggtaactaatgaccaaattggtactaaatatcagggcaacgtaactgccccagttcttataaaaacggcgggtgctatcccaccaaaaacgccaagcgcccatgcgtggtgcctcctcccttgatccggcattgacgaatcaagtcattattaattttattgtaacacgcattgtgttcgttatttttatctaaataattgcttagattagtcactctaggaaaccactttcaactgagtataatggggctaccgagcacgtttcggtaatccgcgcgaatggctgatgaacgaccactgaacttaagagatggtacgtgttaatcatcgttaatgcgcaagcatgagacaagccgtaatcagtattttatcatgaaaacgatgccagatgggtgagggcagcgtcatatttaaagaagatcataaaaaggcgcgatggcaaataaattgccgtcgcgccttgcattgtaaatggaatgcttgttgctatttggaactgctagagctagtcgtggtgctatccgtatcatcagggttggtaattttgatacgagtagaatcagtcttcttatgcgaagcttccggtgcgtcggtcgtatacaacgagtccgttgacttattaccattcttcgagtagagactggttgacttgccagctaatttattttgaatctgaatttctttttcaaggccatcggcgtaattgtaattggaagcgtcgactttcttgaagcccttaggggtgtagaaacgtaacaggttcttgttgttgagtgaatccgagaggcttaattctttgtcgactttcttctgatctttgtcaacagtcttctgaacggcctcatcatcatcaatcgtttcgccagtcgcgttgtcataaattttgccgctaagcacggtgtatttagacgtgacgaaatcgcgatttctaaacgcaacggtactatcgtgttgtttagagaagaggtcggtcccaaactgaatataacgtttgcttgaaatccctaataagtgcagaatcgttggtaggacgtcaatttcaccgccataagtcgattcgactttaccactcttgattcctggaatattgatcatgaatggcacacgttgaagctgggcgctatcaaaggaagtccagtcgtccgcagatttaccaagaatgggtgccaaggtcgagttttcactgttggacaagccgtagtggtcaccataaagtacgatcatcgaattctttaataaaccagccttttgcaagtaggtatagaattctttgacggattgatcgaggtagtgggcggtctggaagtaaccgttaatggcggaatcactagtatccgttgtcttaaacgtcgtatcttccttatcaagtgtgaatgggaagtggttcgttacggtgatgtatttgacgtagaacggttgttgtagccgttcgagatactgaacggaattcttgaatagcaacttatcctttagaccatacccggttgatttgtcaccagtcgtatcgaaataactggcatcaaagaaatattggtaccccatattcttatacgtgttattacgattccagaaactggccacgttaccgtggaagacagcggaggaataattggctcgttggtttagaatcgcgggagcggcctggaacgtattatctgagcctaattgggagaacaatgatccagttgaaagcccgtaagtactagtttcaagcatgttttccgcgtcagaagtcttcccttgaccaacttggtggaagaagttcttaaagctgtaagttgagttgctatggtacagcttgttcaggaacggcgtcacttctttgccgttgaccttttgatcaataagaaactgttgaaaactttccaaatgaatcacgataacgttgcgacccttagcaatgccgtacatcttagcattcggtgcagcgtagtgcgactgtgtataatcctttacggtgtctagttcggacttcttcgcgctggcccgttggtggttggtttgctcgtctttgataccgtcatagacagtaaaagcatccagcccgagatatttgacgatataagtgcggtcaaaggttctggtcaacagttgtggtcggttagattcagctaaggtcaagttgagaccgaagcccgcaattgcagccgaagtgtacgcaaaggccgtgtgttttgcaattggttgcgagtcttgcttgatacggtgaagaataaccagggccaggataataacaatatcagcccagtaaagcacatcgccccaactcgctagggctaacgatgagccggtgagcccttgactgactttggaaactcccgtcatggtactgacagtcatgaaatccgtgaattcacgatggtagataacgttggcatacagtaaaatggtgtcgagtgcatcaatgaatagcaaaatatagtaatatacaccggttttacgaatgtagaacgccagactaaacagaaagactgtcgttgcaatcgggttcacgagcatcaggaatgcctggagtggatcggcaatgcctagtgaaaattcggttaaatacgcataaatcgttttggcccagaataagaagactagtagccaaaaaaatccaattcgcgtgttaacgtgttggcgaaatttggtaaacatcgataaagacctcatttttaacaaatttggatatgactcgataaccagtcatcaaatcattttaacataacatcggaactcgtaatcgctaacaattttaagaatgcgttaatttcgggtcaagctaatttgacggtggcagctgaaacgcgtattctcaaagtatttgagagataggtgatagcaggatgcagataaaaacgagtaaccaggttgattcagcagtttatgcggatgccattgcaattcgtcgggcagtctttgtgcaggaacaacatatcgatgaagctttggaaattgatacggtcactctagcgacgtggcactatgtcctgtatgatgatcaaaagcaggcggtggccacagcgcgagtgacacctagcgatcagtggacggggcatgttcaacgagttgctacgttgaaagcggcgcgagggcagggctatgcacggcaattgcttcaacgtattgcagcggatgggctgagccgtggttggcggcagttgatactaggcgctcaagtcactgcacaagggttttatacacaattagggtaccagccacaagggcgaccgtttatggaggcaggtttgcgacatcagacgatgatattggcattgtcgtaagcatattggtgtaactttcagttggtgattcgagtcaaattccagaataaaggtgccttcaacttagggcttagctttgtggttatttttagcgagacaatgtaaatggaatttccagtagacttctaggcatagtcctaggggtcttttttgtctaaacgattagttcggatagttcgcaaataaaagttttaattcgtaactagctagcgagttgcagtattgtacatatggaaccgattagcatgaatcactaaccggcaaccaaccctacaatcatacgcgactgtggggggtgttggattgtgagaatgacaaagcttttttttgaatgggggaggagcgtatgcgaagaaagctagttgggtatatgctaagcatgttgacggtaatattagcgctatttatgctggggagtactgcacatgctaaagaaatcagtgttacgggtttaacggctggcaatgccatcgtgcttgatgcgaatggcaaacccgttactgacacgagtacgttgaatgataaggctggctaccaattaacgtatcattggagtattccagattctgaagttattaaagccggcgatacagcaaccgttgagattccaacgtatgtcagtatcgatcatgatgttgtgatgccgttaacagattctgccgggcaaaccttgggcacgtttacgtatacgaaaggtgccagtaccgggacgatcacgtttacggatgcgttgggcacactcaatagtcggactgggacactgagcatgaatgcgaagggcaatgcgacggcgacggaaggatcagccgaaattactaaaagtggcttggttgtttcgtcggggagtgatggtgcgccaacggtattggggtggcacattaccgtgacaccgggcaataactcgacggttgtggttacagatacgctagggcccaatcagacattcattccagattcggttgcggcacaggccgtgcaaattatcaatggtatccaagttccacagcaaccgttaacaccgactgttgcaattaatggtaacgtgattacttttacgcttaacaacattcattcgccgtttgtgattacttataacactaaggttgagaattttaatccggctgacacagctaaatggcataatacggctgcattggacggactaggtgttgatgcgacggccgatattacctatggtggcaatggagtatcaggtatgacctatactattgaattaacgaagcatgatgcggcaaccaaggccgtgttggccggagccgtttatgagttgcaagatagtacgggtaaggtaatccaaactgggttgacgactgattcgcaggggcaattgattgtcaaagatctacatgccggtgattatcagtttgttgaaaccaaggccccgcttgggtatgaacttaataccaccccagtaaaatttactctcggcggtattaagccagaggttgcttttcaggtaagtcaggatgatgtcaagcaaccagttgtgccgacaactggtgatgtcacgttaaccaagactgatgccacgaccaaggcggcattggctggggccgtttatgaattgcaagatgccactggcaaagtgctcaagataggattaacgacggataccactggtcaacttaccgtatctggtctgaccgcgggcaattatcaatttgttgaaactaaagcgcctagtggttatcagcttaatgcggcaccgttaccatttacaatcaagccgaatcaaacggcagtggtaacggtagcagcaactgatgaaccggtcactgaaccaggaacaactgaaccgggcaaaccaggtgaaccaggaataactgagccaagcaaaccgggtgaaccaggaacaactgagccaagcaaaccgggtgaaccaggaacaactgagccaagcaaaccgggtgaaccgggtgaaccaggaacaactgaaccaagtaaaccgggtgaaccagggacgaccgagccaagccaaccaagtttacccggtccaagccaacccgctgcacctaacccgggacaatctggattaggtcaagcggcattaccaggactgatcaagcaaccaagcacgggtgtcaatggtgctggtggcactgtgggtaatggtgtgacaactggtatgaacggctttggaacgccaactggtagtgaccaaagcacatcagctggctatagccacggaactttgccgcaaactagcgagaagcagacgccgctttgggtgattttggccgggattttgggcttgttaattgccgcggtggggatcggttatcgccgtcgggcttgaggacgtatgaattgatttattaaagtgtcatgtagggattgatgataccccagaaattttatggtttctggggtattgttttggttatgtgtagaactaacattgtttacggattcagttcagaatttcaatcaataaatttgaattatcgtgtgagttacgattaagcagcatggcctagctagctgatgcggagattgttggccgtgtggtggcatacgcaaaatcattggcaccgtgaatgacggaacctggcgatgaccctattagttgttgtcgttgctagtctgacgatactgagtcagtcagcggtgactatcagattctcggtgctcacaaaatcattcagcataagcggttggccatttgcgacgattcaatttagtatcgtaaaaaagttgcgtttccagatttgacgtctggaaacgcaactttttttactcaaagattaggctaactaattgctagcgtttggtagatgatgggcgcaagtgctgccaaagtgtggctatagctggtggttcattagcccaacgtgcccaccctgaaaatcccactggaacgatgaggttacttatcgtaatcccaatgaaactcatgagtgcaagctcctttaagattggtgcggtcgtcaaaagcagtggcagtaagtaggtcaattcaatcattgttaccgggcaaacgaatcgtccactagtataaaagtgctgttgcagatgagcgggctccaagtgccgtaaccaactttgacggtaaccggttgcggtggtaatcattagccagtgcagtgacaacaacactaagctaccaagcagaacactgctactgagcggcccggtttgcaaccagcgtgttaatattaactgggtccaaccccaactagttaacgtcacgccagttaagcacgcggtcattaacagactgaaggtcaatgaacgcaggccgaaccataaaacaactatgccgatgattaatccgagtgtgagccatctcagtgcgtgggtcgcaatcagggtatgctgacagtgctgttgctgtgttaccccggttgttaggattttggcgtgcgctaagggcgtggcgagtaggctgtcgtgagtgaccgcctgaagtcgttgcagggtcctgcgactagccgcactagccggcgctgatttcaaagtgaccgttagctgtgtcatgcttaaatcactactaatattagtaaaaagactgttttgataggcctgattagtagccgcgttagcaggcaggtaaaaactccggccaacttgactagcggctaaatcatgtaaataggtcttcgtatttttcagtgaagcgagtaaggtggttaagggttgaacggtctgcttcaatgattggttgacgtggtgaacacgttgatcaacgtgtccagcttcggttgcgaccgtagtttgggccgttaccacgtgatttagtgcggtcgtcatgcggtcagtcaggtgatctaacttggtgacctgctgattaactttggttaaatcgggttcagcctcagttgatgtcgttagcgtcgtgtcaatagcctgtaattgccgttgcacctgatcattcagttcagccaaatcattgatgcggtcggacaactggtcgaccgacttggtatggcgaccagtcgctgcttgttccagactttgttggtcagtcgcgagttggctcttgagtttcgccatactcgtcagtttaccagccaaatcaatgttgatagtcgcaagttgctggttaacgtagaaagtacttagtggttggccggtgggctgggtcactgagatgacttgagctacatttggtacggcccgcagtttagtcgtcaggtgatcgattgtttgtaatgattgctgctgcgttaaattctgcggtgctcgtagtgtaattgtgattggcgccgtggcaccggtaccgaagtgagcttggactaattgctgacctaattcagcattactaagctgattttggcgccagggtcgtaagttgtcatcggcaaactggccgttagcaagaattaggccggggagtagcaacagtgcgacggccaagctcccaagtgctggttgccagtggccgaacttgctcaattggccccatagattgcgtggacgggtcggccaagccgttgttcctggccaaaataaattatcaccgagccaagcggtaaaggcgtaattgagcggcggtactgccagtaaggtgattccaagcgctacagtaatggcccaagcagcggctaatgagatgaaggcagtccagtgtaaagtgatagttatgagtattaatgggataaaaacaagtgcccactgtcgatattgaagtgtcagaattttgagactgacagtggtcggtgcggttgttgcgctcgattgccaatacgcgtacataaagtgccatgtcaatagactagtcagtattaaactgattagaccagcaaggctcagcgcattagcagtcagtggccaatgccaagctaaacgcgcgttagtgataaagctaatcgttgtgatcagagtgaccacttgacacagtaagttcagtaatggcactaacagtgagcggaagatgaggccgagaatgattaaactgagcagactaccgacaagcatgctaatcagcaagttgcgacgttgttgttgcacgtgttgttggtaggtcaagtccgtactggtgacactcgtattgaggtcggcgattgcaatcgcattattaagttgatttgcaatcacagataggtcagcccgggatgtctgaacggcgacaagggctaattcggtggaaccatcattggaacgtaataagtgccggtcattagtcataccggttggtgttcgaagctggttaatgccgtaatcatcggctcggcgattaagtttggctagggtcgtggcgatttgttggcgttgctgtttggataatttaccatttgaattgttgaagactaacgttaaggactggctgttggttaacccgtgaccccattgttgttgatacttaggactcgttgttgcatcttgtggcattgcggtttgttcattcacaaacgtggtaatgttcggtaaaatcagaatacttgcaaacaccacgattccccagaaaaataagaacaaccactttggttttaataattttcgcattcgtcttgacgcccccacatcaattactttattttgacttaatcttaccatatcaggtgttagagaagcggtttgatcgtcggtttgaaaagttaattacagtaattacttgtgagttatggtatcctaaaacgctgtgggaggtgctgtttttgaaaacagatcgatttcaggcgttcagtgatggtatttttgccattttaattacaattttagtcttagaatttcacattcctgattaccaaccgggacatttactggcggcactattagcgcaatggccgttgatcttgtcgtatgtcttttcgtatttctacgttggcacgctgtggttatttcatcatgattatttcaacatgctacaacgaattgatcgcaacgttaatatgctaaacttattaatgctctttagtatcaccttattggattacccgatgtcattagtggcagatgcgttgacaactggtaatcgacaggatatgcaaacggcatttatcgtttatgatttggttgccctgtttatttcggcgacattttatttcatgtacgcttatctgcatcatcaccaggacctaaagaagccgggaatctcaatggctttttacgccgcaattaagtttgatccggttcgaagtgtcacgatttatggcttagccatcgtggcaacgttttggtcggtatggttaggtgcaatcttactagcaggtggcatcatttttcactttttggcctacttacggatgagtcgccagctagaacaggcgaagggggggacggcataatggattattcaagtttattaggacctgatcgttatgatctagccgtgacgttagccaagcagtatcatcttgaccccagccaggtcttgttcggctatttgcaagtggttagtcaagttacgggtggtccgaatgcagcgcaagctgatttacatgagccccaagtacgagcagcaatcaatcaggaatttgatcattttttgaagcagcttcattaattaaaaatcacgatgtgagttcagtctcaacatcgtgattttttagtttcaatcggcagggaagaggtacggtgttcgccaggttgctgccatttcaggtgttagtgtcagtcgttgttcgtgaccagtcgtgcgtggaataaagcggtaagtacgagtcgctaacgtgatcaaacaacgatagtgcgtgtagttgtggctgatgagatggcgacggtcggcgtggtatggcaagcttacttcttgtaaccagcggaataaagtggtcggcacttgttgcggtgctaactgcggtgttcccagtcgtcgaagtgccatgtgaatgaaacgatcagtgggaatcggcccgctcggtaatggttgcttagtctgaatcacgtgctgagcagcctgacgagtggcagttgtaatctggttgccagatattgctaaataaagatttagtcggcgctgatggtcgcttaggactggtgtattggtcaggacgccggctggattcggttgcgcagtcagtgggccaccagtgggttcgatgacgacactggtgtgtgcatcactgagataccagtgaaagggatagacttcaccagtgtcatcaccccaggacgcaccgaccaggttaacacttggcagatcggcgatcacggctgcgactgattggtgttcacctaaagcccagttgatgaaggcttgaggtgttaaattaatttggttgacttgtggttgagtggcgtattcaacggcgtggggcaagtacagttcagcacacaccaaaccagcttcgttaatgccgtcagccatcaaacaagccttaaagtggtcaggtagccgaccaccaccgagaatggcatactgcgtcatacgcgtcgtcgctaacccagttggccacggataacggcgcggcaaaaaaattggccgccaaggtgtcgttgttggaaagtccatggtgcgggcgaagtagcggtgattgtcagtatcaagataagttaagctggtacacatggcgcggcctcctttgaattaggttcattatacgtcaaaataggcgacagctaaatgactgtttaattaacgatggtaacggttactttttttgatgatctgcgtgtgcaaaacagctggcagtgcaatcagtgacagattaatttatggtcggatggaactcattattttctaatctttacaaacgtgctataatgaggtttcaataactatcaaagcgaggtcttcatagtgagtggatataacgtcgcgattgtcggtgcaactggtgcagttggcgcgcggatgatcaaaatggtggaacagacgagtttacctgtcaactcagttaaacttttggcatcaagccgttcagccggtaaacaattacagttcaatggtcaagccttaactgttgaagagaccgttcctgaatcattcgaaggaattgatttagccctcttctcagcgggtggctcagtatctaagaagttcgcccctgaagcagtcaaacggggtgccgtagttgttgataatacaagtgctttccggatggacccaaagattccgttagttgttcctgaagttaaccctgaagcattgaagcttcatcatggaatcgtggctaacccgaactgctcaaccatccaaatggtcgttgctttggaaccagtgcgcaaggcatttggtttgaagcgggtcattgtttcaacctatcaagccgttggtggtgctggtaaccgggccttgaaggaattgcatgatgagacggaagcctacttaaaaggtgaagagatggaagctcatatcttacctgttgcgggcgacaagaagcattatccaattgccttcaatgcgttaccacaaattgacgtgtttgaagaagatggctacacccatgaagaatggaagatgatccatgaaaccaaaaagattatgtgtggcggcgacatggacagtaaggatatcaaagtaacggcaacttgtgtgcggattccggtgccagtgagtcactccgaatcagtttactttgaagttgaagatcctaaggcaaccgtcaagggcattcaagatgctttggcagctgcaccaggcgtggtcttacaagacgaccctgataaccaaatttatccgcaagcgcataatgcggaaggttctaaagacacgttcgttggtcgggttcgtcctgaccaagaaacgccacaagccttccacatgtggaacgtttccgacaacctcttaaagggtgctgcttggaactcagttcagattgcggaaaccatggacaagatgggtttattgcacatgcaataaaactaatttgttaagggtaatgaaaagctgatcgctagaatcaatattctggcgaccagctttttttgatgtcgaattattcgagcgttagagtcagataaaatataataagcgtcatgttgaaattaggttcgttttagaaagcaatattaagaatttgttaagctaaaactgatgagtgtcctttatccttgtcctggagtcagctccagcatataagctaagtttattcaaagttagtgaatggtcaatgagatgtcatgatgttaatttgctagctagaataaaattttaacgcgaatgtggaggaattaataatgaaatcaattaattggtcaacggactatttaccagggcatactgataatttcgtgtcaaacgaggtcattacagacggtgtgactttagcggctgtttggagaaatttagtcgatacatcgaagtggacgacgtattatgataatgcgactaacattattttggatgatcaaacggatactgaactaaagtttgcggaacatttccgatttgatacatttggttttcctatcgatgcccaggtcatggaactcgttgagccgacggatggtgaaacagcacgactagcatggcatggctggcaaaatggtgatgcagatactcaatttgatgtctatcacgctttcttaattgaaaaattggcagatggccggattcgattattaacacaagaatcgcaagttggacagcctgctaaagacttagctaatcaaacacccaatccgatgttaaatggtcaccaaagctggctagatgggctagtcaaggctgccaaaaggactatggctgagtaaagtagttgctcagcaagattaataggagtgattaaaagatgaaaacatggttcattacaggaacttcaagtggttttggaaaggaactcgcgaccattgttgcacggcagtctgacactcagctgattgcggctgcccgccacaccgatgatttagcctacctcgatgtttttgacgcgacgcgtattgagaaagtcagcattgatgtgacaaatgaatcacaaattaaaactggggtcgctcaagcgattcaacgttttggaactattgatgttttagtgaacaatgctggcttaggctatttttcaacaattgaagaaagtgatatggcgaaagttcgctacatgtttgaagttaacgttatgggactcgctaacgtgactaggcccgttttaccgaccatgcgggcacaccatgctggggtaattattaatttatcatcggcgttggcattaacgacactaccaaccatggttttttacagtgcgacaaagtatgcagttgaggggtatagtgataccttgcggcaagaagtaaaagacttggggattcaaattatgacggttgaaccaagtggcgctcgaacgcagtggtcagggcggtcatcccaaaagatggtaccgacaattgcagattacgccgcgtttagtgacgcgattacgacggtatcggactcggttactcaggcaccgggcaatccgcaccgaattgctcaggttatgtttgatcaggccaatttggcagaagtaccggcacacttgccattaggtgaatttgcctatcaaggtggactcgctaatttacaaagcattgttagtgaaattaagtcacgtgaggacctttcattatcgacagacgattagctgcgttaagatagtggttaaacgacaatcgaggaggttcagttcagtatgagttattcaatcggacaagtagctgataagttaggagtgacgattgataccattcgttactatgataagtcgggattactgccattcgtgaagcgtaattcaattggccggcgtgaatttactgataatgatctacatttgatgaggaccattgtatgtctcaaaaatgcgggtgtgtcagtagcggacattgctacttttattgcgctcagactcgaaggtgatacgacattaaacgatcgttaccaattactcaaaacgcatgagcaggaattacaacagcggattaccgacttacaggatacgatgagttatttgaagtttaaggagtggtattatgagaccgctacggctgccggacatgaggatattcattttgtaccgggtactaatgaagttcttcccggtcttgaccaggaatatgatgcgtatttgaaggcgaccggtcaactggttgagctgtctcgatttgctaatgtaaaggattatcggttgcgcaagcgatagtccttagcagtttcagtttaatcgatgaaactgtacagaaaaactggttttgatagcttggatattggataagaataaccaaaataaaaggttctgaattgtcagttgtttgacagttcggaaccttttgaaattaaaagcagcgtatatttaagcaattagttgtaagacttgtctaactagcgccactggtacgggttgatccaggccaatgttcagccgcttttgaccggttgcgtaaccagcagttttagcagcagtgagggtcgcatcgtcaaggtcggctgaaatacttagactgacatgggcctgataagcagctatgctcacgtattgtttgttatgttcatagaacggcaaattccacttgattttagcagtaaagtcaggcaattccgatgtaatcagttgggcaagggtgctcaagattggttgtgcagcgattgcagtcttattgatgtaatcattggtatccgtgactttaactcgactaggcattgttaaaacttcctttactttcgaaatgaatttctacgtagcaaccaaatggttagggcacatagtgcaacggcgatgaataccgtaatctcccaaccgaatggattcttcatgaacggtaaatcgacgttttgcccgaaaaaaccgaagacaatgttgggcattgtcaggacgatggagaaaatcgtcagcacccacatcgtgttgttcaaactgttgtctagaatgttcgagtaggcgttcgacacccggccgatgatgtctgaggcaatgttggccatttccaatccttgttgtgcctcgacaataatatcatcgagccgttctaattgggccgccgagaatttgaccggtacaaaccgtttgagtgactgcaacatgtcgttattacttttaagggacgtgaggaaatagactagcgttgtttctaagtccatcaattgaataatgaccgagcgctgaatttgctttttcatcttcatctgaatgtcttggcgttgtttgttgatcttgttgatggctgaaaaatattgccgcgagagcttgtacaagacgttaaagatatggtcgtacggatgcaggacgtcttcccaatcggcatcgatttcgtctgccaacatatcctcaacgaacatcgtgttatcagtcgtgaaagtcagtagggtgtggtcgatcaacatgaaactgacctgggcggtataagtaccttcctcaacgtcttctgtgaccacgtcaaaaataatggtcgtgatggcacttttggcgtcatattccaaccggcctcgttcgtgttgatcggtcgcatagcctaacatttcgtcggtgacgtgttcctcactgacgagttggtgataatcattttcagtataattattaacagcgacccagcgaaaatcgtcgcttagttcatggacttttatcattgtttttacttccagcgttttgagatatcttcaatttaacatgagttgcgagacaacgcaaaggaagttttaaggccacctaattatttaacagttgtccggcttaacgtttcacaccataactggtgactgcgactgaaaagtgctaacaataaatcataactgataatcagtaaaatgactgaaacgacgacgaggtagacatccaggcggttaagggtggcactaggaacgttgccgagtcgattgaataaccataaatccaaaaataggagtggtaagccaattaagtagagcccgccatagtgaatgagcagttgccagagattggcccgtttaccattgacggtcacaatctggctattgagcaagcgaccaccaatggttttaccttgccaacaccaggcaggtcctatgaagaatagcaggatgtcgaccaggtatagccagcgaaaatcatgtggtaatggccaattaaagtgtttgactaagacaaagtagacggtgtcaaaagcggcaattgcaagccaatcgatgaccaacgccccaatgcggcgccaattgatggggtgttcctgccaattcaaccgagtactgtggtcgcgattgcgccactgattaggaatcagatgtagacaccaagcgccgacaattccgcccaacgtattcatcattaaatcgtcgacatcgaacatccggtaggcccgtgaatagtagccgtataatccggttaactgtgtggtctcgaagaacaatgaaatcgagaaactggtcagggtgatcaaccagagtggccagcggtgccgccacttcaaataagcgccaatcggcatgaataatagaacgttgaagaacggctggaagaacgtgtcagatttgaaggcggctaaccaagtactggggtccccaagttcaaacggcgtgagtgccttcaactgggtgagaaagtagaagggttgtaaattatactcggcggttgtgaggctagccacggatgagcgagtcgggagtggcagaataattagtaagtaggctgctgccaagtaccaaataaacgaataggtactgatcaagttacgctcactcagtgtttgacgtgttcggagttggatagtcaggataatcatggcgagtagtaaggtcatgattggtaaagctaagataacgatgtgcacgggttccagcaacgtactgacaatgtgactggaaagtgcgagttgataaagtttggtaatgagttcgtgcatggctggtctccccttttggaatagcactattctttaactaatgttgactatatcatggtataaagaaattgtgacgattaatataaataaataagtaaattgttagactttcgccgtgactgcgagtgtactgtctcgaatgaccgtttcggccatgcttgcttatctaaaaaaaatatggttgaataagcataaattatgagagggtgatgaggacatgctaatggatgggcatacccacacggaactatgtccgcatgggagtggtgaagcaacggaaaaaatgattcaacgggcaatccagctcggctttcagcggtattgtattacggagcacgcgccgttaccaccagcatttcgtgaccagtatgaagggacgctggccggttatactgaggcgtcgttgcgggaggaccaagtggccgattatttggcactggctaacggactgaagaccaaatatgccgggcaaatcgagatctcagtgggttttgaagttgatttcttaccagagcatgttgcttggacgcgtgattttctgaatacctatggtcctcggacgcaggaaagtattttgtcagtccatttcatgcgggggttacggcagcatttctggtgtgttgacatgtcaacggatgattttgcagccggttttgggcagtggcttaagacgccccaacgtgtttttgaacagtattatcagacggtcttggcatcagtacaagcagatctgggcccttacgcaccacaacggatcggccacatgagtctcgtccgcaaatatcaggattactttggcttgactgaacccttggatgtccataatcttcaattagtagatcagacgttggcgttagtgaagcagcaacggcggcagttagatttgaatttggctggtctctacaaaccgtattgtaatgatttttatcccggtgaacagattctacaacgcgctcaaaagcttgacattccgctggtttatggctctgatgcccacgacatagccagtgtggggcgtggctgtcatcttataaaaaaattaattgagggttgacagccgtcagtttagtgattacaatgaattataaattaaacgactaatcaaattttaataaacggttgtgattagaacaagtaattaagtcttcctcatccagagagcccgggtagctgagaaccggacagacaggcttaacgaacacacatctatgaactgctaaggtgaaccagtctcattagccttagccgaattggtttcgttatccaagttgacttgatcaacatgaggtctgccgtgcgaacggtagatgaaataaggtggaaccacgcgtaaacgtccttttagcaaattgctaagggggcgttttttagtttcaccgatccatgcggtaagtttgcgtgacggaatcgcaagtcgctccagttagcatgtaagcaattgattaagcacgttgataagtaacgatgtgaattaaattgattagttttaaaaataacgacgttttaggaggcgtaaattatgttgaaacacttattaccactaggaacccgggatgaatttggtcggcgggcacgtaccaagcaacacttgatcgcggtgatccaagcccattttaaacaacgcgggctcgcgccaattgcaacgccgttattagaaaacgaagcggtgtttgatccatatcagatgggtaactaccaactataccgcttatttggcaacgatggtcgcaccttggtcttacggccggacatgaccttaccagttgctcgcttcattagcgcgacgaatgtccccttaccgcaaaagtttggttatgtcggcgatatctttcgagtaagccgtcaattatcaggttcatataaccaaatcacacaagcgggagtcgaattagtcggttacgcatcgctgaaagccgaatttgaatgtttaacgattgccaaccagctttcaagtgagctgattgccgatgctgttgaaatcgaattaggagatgcccaatttgcacaacgtgtcgtggccagcttgactggtgacgaaggcgagcaacaagccattttaaccgcactgttcgataagcaagtgccacgctacacgaatttgattgccaagtatcgtgcgcaacctttatatgattttctcaaagcatggccgcgtttgttcgggtgcccagaacgcatcttcaaagaattggcggcagcaccactacctgaaacggtccaaccaagtctgaaacggctgcaaacggtcgttgcctggatgcaacaaacgataccggagcaggtcatctcggtggatttgagtagccaagcgccccaaaaatactataccggccttacttttcggggttattcacaagccggcgcgggttatttgttcagcggaggacgttatgacaaattactaacgaactttcaagccgaggctgaaccagccgtggggatgggacttaatgttgacttgctcacgaccttagccacgaatcaacaaactgcctacgcggaacagctgatttactttgaacctgaacagtggccagaagcagaggcctacttggcaaaacagccgaacgccattttgagcctggccgacgatattcagggggcccgcgttgaagcgcaacgcctgaatgcccaactaatcgatttaactggaggtgtgaccaatgactgaaccacgattgaagattgctttgacgaagggacgcgtggaacaacaagtgctcccattactagaacaagcggggctggattgctcacaagttcgtaacaagcagcgccgtttgatctttgattctgagacgcaaccctatgaattcattctagccaaggggccggacgtgacgacctttctcgaacggggtgctgctgatatcggcatcgttgggagtgacatcttgacggaacacgagagtactcagtacgagttactggacttgggcgttggcaagtgccaattcgtactggcatctaccgcagactttgacccggtcgccccacgccgcaaaattattggcaccaagtatccactcattacccaacggtattttgatcgtttgggccaggatgttgaaattattaaaatcgaaggctcagttgagctggccccactgactggcttagccgacgccatcgtcgatattaccgagacgggaaccacaattcgtgaaaaccatctacagatttatgactatttacaacccgtttcgacgcgcctagtcgtcaaccggttggccttaaaacaacaacaaactgccatcttcgatctcgtcgatcggttggccgcagtcgtcaatacgaataattcaaaggagtttgcctaatgaaaattattaatgaagatttagccagtttaaaacgcttagttcaaacgaagacccaacaattgactgacttaaaggttgaatcagcggttcgcgaaattattgccaatgtgattaaaaacggggatgccgccgtcaaggattacgaaacccaattcgataaggtcaacttgaccgactttaagttgtcacaaactgttattgatgatgcttataacaatctggacccgcaagtgaaggacgccttgttgttagctaaacgcaatatcacgagttttcacgaaaaggaaaaggcgactggctttattgatgctgaacagcctggcgttctaagagggcagaagttaatgccgcttaatcgggttggcttatacgttccaggtggcacggcagcctatccatcgactttactgatgagtgccttgcccgctaagattgccggcgttaatgaagtcattatggtgacgccaccacaagtcgatggcatcaatccagccgtccttgctgcagccaaaatcgctggcgtcgacgccatctatcaagtgggaggcgctcaagcaattgctgcgttagcttatgggactgagtcgattccagcggtcgacaagattattggtcctgggaacatttttgtggcgactgctaagaagcaggtctttggtaaggtggcgatcgacatggtggccggcccgtcagaaattggtattttagcggatgattcagctgatcctcggcaattagcggctgacttattgagtcaagcagaacatgaccgtcgagcccggccaatcctaattacggatagtgccgacttagcgcaggccgtcagtgacaacgtgacgtcacagttgaaagttttgccacgagaagcgatcgctaccgacgctgttaacgaaaaaggcttcattgccgttgtcgcaaaggttgaagaaatgtttgacttgatgaatacggtggcaccagaacacttggaagtgcaattgaagaatccaactcagtacttgaatttaatcaaaaatgccgggtcggtcttcttaggacgctacgcctctgaaccactcggtgactacgttgctggtccgaaccacatcttaccaacgagtggcacggcccgtttctcatcaccacttggcgtctatgatttcgttaagcggacgtcctttatccaatacaccaaggacgctttggctaaggaagctccagcgattaccacgttggcacgggtcgaaggtctggaaggccatgctcgtgcgattgagagtcgttttgacacctattacgattaaggcgtaattagtagttgatactgattgtgatcacagtcggtagtcgttttagcagatgaggaggaaatgaatatgcgacaagcaacgattaaacgtgaaacgaaagagacccagattgaaatcagtttgaatttagatgaacagagtggtatcgaaatcgatactggaattggttttttaaatcatatgttgaacttattcgcgaagcacgggcgcttcgggttggtcgtgaagtgtcacggcgaccttgacgttgacccgcaccacacgactgaagacacgggaatcgtgctcggtgaatgctttaagcaggcgttgggtgataagcagggaattgaacggtacgggacggaatttgtgccaatggatgagactttaggtcaggtcagtgtcgacctaagtggacggtcatacttagtttttgatgccgagctcacgaatccgcggctcggtggcttagatacggagacagtcgaagatttcttccaagccgtggcctttgctgctgaaatgaatttgcacgcacgcatcctgtacggccgtaacactcaccacaaagttgaaagtttgttcaaagcgtttgggcgggcaatgcgcgcggctgtcacgattaatccagatattcagggggtcaactctacgaaaggcgtgatttaaatgtttgcaatcgtcgattatgatacgggtaatacccgtaatttgaaaaaagcctttgactacctccaagtgccgaccgttttaacggccgacccgcaacaactgaaagctgctgacgctattattctacccggtgtgggggcctttgcagccgcaatggccgctttgaaagaacggcaactagtcggcgtgttacaagcattagcgcggagcggcaagccggttcttgggatttgcttgggcatgcagctcttgtttgaaagtagttccgagtacggcgagcatgctgggctaggcttgttaagcggccgggttagcgctttgccaacggacttgaatgtcaaagtcccacagatggggtggaatcagaacgagcttcggcgtcctgatagtccctttgccagtattgacgcggcctatacttacttcgttcattcgtactatgcggtatgtccggcaactgaaatcgtggcgacagttcaacacggcgtccaggttccaagtattgttcagcatcaaaatgtgattgggatgcagtttcacccggagaagagtggtcgagtcggattacaacaactagcagcttttaaggaaatggtgagtgcaaatgatttttccagcaattgatttacgagccggtcagagtgtccggctctaccaaggtgattttaaacaggcgacattgattaatcctgatcctgtcgttcaagcccaacaaattaacgcagcgggcttgcagcaattacacatggtcgatttggacggtgccaagtcagggcgcccagaaaacttcgcgacaatcacggcgatccggcaagcatttaccgggacgatcgagctcggtgggggtattcgaacctacgagctggcgacccgctatctcgaattaggaatcgatcgcttaatcttggggtcagttgcgttgactgatccacgactggtcaaacgactgttaagtgagtttggtggtgagcgaattgtgattgggttagacggaaccaatggttatgtggcaattaaaggctggttggagcagtcacagaccaagatgagcacattaatgaagacaatgactacgagtggtgctaagcactttatcgtgaccgatgtcgcccgtgatggcacgatgcaaggccctaaccttgcgttataccaagaactacaagcacaggtgcccacggccaacctgattgccagcggtggcgttcggaatttgaccgatgttcaagtgttacaagccagtgggttcaaggatgttattattggcaaggcgttagctgaaggcggtgtgacactggccgaattagcgggggtgactgaatgttagcaaagcggattattccgtgcttggatgtggcggatggtcgggtcaagaagggcgttaatttcgtcaacttgacggatgtcggagatccggtggcgattgcagctgcctatcagcaacagggcgcggatgaacttgtctttttagatattgcagccaccaatgagcaccgcgagacgatggccgccatggtcgaacaggtctcagcccaagtcttcatgccactgacgattggtggcggaattacaagcgttgctgatatgcaacgaatcttacgtgcgggtgctgataagacggctattaattcggctgcggttgccaaccctgaactgattcgcgccggggctgaaaaatttggcaaccagtgcatcgttgttgcaattgatgcggcgtgggatgcagcggccggtcagtatcgggtctatacacacggtgggcaacaagccaccgacctcgacgcagtagcgtgggccaaacaagccgtcgccttaggggctggtgagctactggtcactagcatggaccgtgatggcacgaaggcgggctttgataccaagttgtaccaggcattaggagcggcggtcaacgtaccgatcattgctagcggtggtgctggtgacctacaagacttcgtggatgtttttgaggaaaccccagttgacggtgctttggccgcctccgtctttcactttggtgagttaacgattgcggatgtcaaagcagcattacgaaagcaaggagtggtcgtaagatgaaaccagactttgaaaagggtgacggtttactgacaacggttgtcaccgatgcggatacgaaggacgtcttgatggtcgcgtggatgaacgcggaaagctatcaacggacattggcgtcgggccagacgtggttctggtcacgttcccggcaagagctctggcacaaaggcgccacgagcggcaatttgcaagatgtcgttagcatgacgttggattgtgatcaagatacgttattggtcgcggttcatccccacggtcccgcttgtcatacggggcatacgagttgttttttcaacccggttgaattagaacaggactgatgatgttggattgccacgatgaccgtataatttgcgggttcagtggctcatcagttggaaaggctcagtcacaatagcttattggccaattgcatcggaaggattatgtttagtcctcattgaattaacgaatatattatagaagaaagtggtgtcgaatatgcaaaacatggaagaattatacgaactgatcaaacaacggaaggcaacgcctaagaaggggtcttacacggattatttattcacgaaggggctcgataagattttaaaaaaggtcggcgaggaatcgactgaggtcatcgtggcggctaaaaaccctggtgacgacgaattgacttatgaaacggcggacttgttgtatcacgttttagtgttgttggtcgaacgtggcgtcagctttgaccagattaagcaagaattggctaaacgtgaagggaagatgagtgactataaggatcggcccgaaattaagaacctataggaggtagccgaatgaaagctagtattgaacagttagaaccctatgtgcccgaaaagccgttggcgaccctccaagctgagttaggattgacagaattagtccggttatcagctaacgagaacccgtatggcacctcgccaaaagtggcgaccgctgtgaagaattgggacttcacccagagtaatcgttatcctgatgccgacgcacaggagttacgacaagcagtggcccagcaacagggaatcgacccgaatagcatcgtttttagtgtaggtcttgatgagatgatcgtgatgttatcacggacgttcttagccaccaacgaccaggtgctagtgtccgcaccgacgttttcagaatatggactacatgctgagatcgagggggggcaattaatcagtgtgccaacgttgcctaatgaccatgtgaacttcgaaggcttaatgaaggccattacgccccgcgtgaagatggtttggctgtgcaatccgaacaatccgacgggcaccgtggaatcattagcggcaattgaagcgttcgtccagcaagtacccacggagacgatggtcctgattgatgaagcctacattgattttacaccgggcgtggctcaagtaacggccatgcagttaccagccaagtacccgaatgtagtggtcatgcggacattctccaaagcatatgggttagctaactttcgaatcgggtacgccgtttttaataccaaatatgccgcaacgatgcaaactattcggcttccatacaatgtgaattccttggctcaagtggcagccttggcggcaatcaatgatcctaattttgtgcaacaaacggtccaaaaaaatgcgacggaacgtgctaagtggatggcattctttgatgatcagggtgtcacttacgatcaatccggcgcgaacttcattttctttaagtatccgaatgccacgcaactggctgactatttagtgcaccatgggtatctgattcgcactggcttacggccagggtggttacgactaacggtcggaacggctagcgataatcagcaactccaacacttaattcgtgattttaaggcctagaattggcgcaaagaaacctgagtaatcggtttctttttttgttgccctaactgctgaataaattcgaggcagctggtccgaaaggatagttgtcaataacacctgctaaaccattaactcaagtgttgacttcgacgccactctaagcagtaaaattagggtgataaagtatagggggggacaacaatgtcagaattagataaattagcagccggggaatggtatcaatttaaagatgctgaggtggccgctcaaaaagcgcgggctgccaagttatgccaagagttcaatcagatcgatgcaacaaatccagatgcgcaaactgccaagattcaagagattcttggtagttacggtcgcaatctttccgttcaagcagactttaattgtgataatggtcgtaatattcatgttggtgataattttcttagtaattataacttaactattttggatatcgcgccagttcatataggggataacgtgatgattggccccaatgttgatatttatacggtcaatcacccgttgacggctagtggtcgacgcgctaacttggcccagggtcatccggtcacgattggtcatgatgtttggattggggggagagcggtgattacgcccggcgtgacgattggtaataatgttgtgattgcggctggagcagtcgttactcatgacatgcctgataatacgttggtggccggggtaccagccaaagttattcgacaattagaataagaaaggtcgcaatcagctagcttttgggtacttatttcactcattggcatgatgagtcgtaaatacgacgaaaataagttttatttttgaaaattagttcgcggaagcgtcatcaattatttatacgggtatacttagattaacaaactaatattaagagaaagaggatgccgtttgttacatttaatcgaacagttgtatggacccttcttcagtgcgaccaactggggtaacgtcatcacatctgctaatgactggttaatcattttatcgttagcaattatcgaatgtttactttcagttgataacgccgttgtcttagctgctcagacccagagtttagataatttacaagagcgggaaaaatcgttattctatggcttgtggggggcctatatctttcggtttttaatcattgggattggcacgtatttgatcagtttttgggagatcaaagtgttaggtgcggcttaccttgggtacttggtgtatcgatactttagtcagccgaaaaatggggccaaggtggcacagaaacccaagcaacaacgacgcttcttcggactaagcaacttctggtcggtcgtcattcagattgaaatgatggatatcattttctcaattgattctgtattggcgtcattggcaatttcggataatccggtgatcgttttaattggtgggatgattgggattgcctgcatgcggggtattgccgaggtcattatgcgcttaatgcgcaagattcccgagttggaaaccatggcgtattgcttgattgtcttgattgccattaaattatttatttcaattcctgccattggttggaatattcccgcaacggcgtttggtggtattgtattagtagcatttattatcacgttgctgattcatttttggcgccgacgccgcaatgaacagcgcgtagaaggaaaggtgcgtaaatgatgaaattaggttggattgggactggcgtcatgggagcagcgattgtccgtaacttgatggcggccggctatgatgtcacggtttataaccgaacaaaaagtaaggcggacgcgctagtcgcggcgggtgccacttgggcggccaccccggctgccgtggccgaagcgagtgacgtggtcttcaccatggttgggttcccacaggatgttgaacaagtttattttggtgaccacgggattttcagtggattagctgctgggaaaacggtaattgacatgacgacgagtcagcccaagttagccgttaaaattgccacgtacgcgcgtgaacatgacatgcacgccctagatgcgcccgtgtctggcggtgatattggcgccaaaaatgccactttgacggtgatggtcggtggcgatgctgatacgtacgaggcgatgttaccattgtttgacgtgcttggtcacaaggtcaaccatttcggcgctgctggtactggtcaacatgccaagatggccaatcagatcatgattgcagggacgatgactgggttaactgaaatgctattgtataccaaggcagccggtcttgatccggaaaaagtcctggccacgttgtccagcggtggtgctgacaactggagcatggataattacgtgccgcggattctgaaggacgactacacgccgggcttttttgcccgccatttcctgaaggatttacggattgccttgagtgaagcagacgcaatgggccttgatctcgttgcaacggcgcaggccaaacgactgtacgaagtaatggtcgatgtcaaaggcttgggcgaccaaggcacccagggactgattaatatttattagcacatggccaacttgatgaaggtcactcaaacatcatatgtttattgagacaatagttatcaaggcggggattcagtgagttaacctttctgaatccccgccttttattaatatgagacgcattatgcgagttaagttgtcatgaatcgtgattaaaacatgccagttgtgtaagttcaaaagcagccagcttaggactgctggaaacggttcggattagtgtaaacctgcttggttggttcgtcctacaccgacctccaggcatttctgccaattgccggaacgtggtgggcacagatttaagccgaagcccacgtcttaaatactggcctttcactaaccaagcaaagaacgcttgctaagtgaaatttcaccactgggcattgtcagaaacgccttccagtcgggatgggattcgaatggcagacatgtgcgtacccaacctttgttggactcatcattgttcttcataaacagtaattttgtcgagcaactgtcaggcagaaagtgacattgtgatagctcactatttcgaaatcactatagtaataatcgaacgttccaacaaagtggctaatgtaaccttaaagtctcgtttaaaatttcattatcaaaatagccaacgacaaattgtactaagttaagtggccgttcatctgccattcgagcggcttaccgaccggaggggctgggtgacaatgctcagtagccaaattattcttagctggaagtgggttgcttccggcttagaataagactcgtatttgagatgacgcgggctatgcgttagctcaaatcgacgtcggcttacgttccagcaattgtcacccagccccggaggtcggaataggacgctcaccggctgacgaacaggaatctaactggcatgttttaatcacgattcatgctaagtaataactagtacaacgctaagcatggtattttatgaaacgatatctgaaaataaactgggtatactgtcaatcttgatgactagcattttgatgcattaaaaaaaccggacccttcagcgaagtggctgaggggtccgattgatgttgtatggtctaattagtgaccaattgatttagtttaaggttgcggctgctttttgggcagcgacgttgatgatgttccaaggacggtcgaagcctggttggaagaagaagtccgtgtaggctaggtcagcaaccgtcagtttagcttgaatagctactgagatggcattgatgttagcagtaacatcgtacttcgacatgatttgcgcaccaagtacacgaccatcagttgggtcaaaggttagtttgaaccaaaccttggtgttgccagcgtcttcggagacaaatttaggacgaatggtgtcagttactaatatggatgccgtcttgacacccagtttatcagctgttccttctttaacaccggtggaagcaaagtggtagtcaaagacggatagtgcggatgagccagaaacggcaggcattggcacgttttcgccaagcagattcttagcggcaatccggccttgccgacgagcgttagtggctaacgcaatgcggttatccttgccagttggggcgaatggtactaaggttgcatccccaacggcgtaaatgtcggagtcactcgtttgaagacggtcattgattttgatcaaaccgtgattatctaagtcgataacgtccttcaagaagccagttgcgggccgaatcccggcagcagtgacgactaggtcagctggatattcgccttggtcggtgacaactttggtgacgtggccgtcaacgccttcatacgctttaataccttggccaactgcagcatagatgccgtgattagccatcgtcttagttaagatatccgtgaattcttgatcaaggtataggctgagtaagcgaggtaataggtcgataaccgtgacgtgcatgccagctttggcaaagacttcagccgcttcgataccaatataaccagagccgatgacaacgacattcttaacactagggtcaacagtcttggcctttagttttatggcccagtcgcggccacgcattgcgtagatgttggctaagtcatggccaggtactggcaggtcaaatggcaccgcgccaacacttaggactaatttgtcataagtttcatcacgttcgtcaccagtggcgtggtcaatgacgtgcacactgtgactagctgggtcgaccttgctaatttcactatttacgaagacgtggacgccttgggcttgcatgccagcaggagtggcatagctgacggtgttaacatctttaacggcaccttcgaggtataactgcatcccacatgagaggaatgacagaaaatcacctttttcgtaccattgaatttcagtatctggttgagcggctaaaataccgcgaaccgtttcataaccaccatgagaagaaccaacgacaataactttcataattgtaaagcctccaaattttagtttagaactgttctaaatagaatataccacgaactaggtttgtcgacaagggcagttgataattattctaaattacggctgaaaatggctgtgcacgtcgacaccatttagtttagaaatattctagttaaaatatagcactaaaataaattgctcacaactaaaacggttacaattaactgcaaaaaacacccaatcatcaaaaaatcgatgactgggtgtcagtgttaacagggctagacttcataattattcaataatatcgaagaagcttaacagtttttctttggtcagttgggctttttcgtcatcacgaacatcgtacttgatctgaccttgatcaaggacaatcaggcgattgccgtagcgtagtgcatcgtctaagtggtgggtaatcatcagacaagttagcttttcttcagtgacccgttgatttgtttgggtcatcagttgagcactggtcttaggatcgagtgcggccgtgtgttcatctagtaacaagaggtcggggcgttgttcagtagccattaaaaagctcagggcctggcgttgaccaccggataagttttcggttgccgtgttgagccgggatgaaagaccattgccgtccatcgtttccgttagggcttgaaagtggggcaggtgtttttttaactggcgtaattttaacgtgcgccgctgaccacgttgactggcgagcagtaagttttcggctacggtcatccggggcgcggtccccatcttggggtcttggaacacgcgtgccaagaaggcggtccgcttttcaacggagaggtgggtgatatcctggtcacgtagctggatggaaccactatcaaccggcaactcgccactgatcgtattgaagagggtcgacttacctgcaccattggaaccgagtacggtaataaaatcaccatcataaacgtctaagttcaggccccgcaaaattttgacctcattcggggttcccggattaaccttggtcacgatattttttaatgataacaatggggcgctactgttcgtcataacgggccactcccttcttcaaaacgtgattgagatgtaagactttactgaattgcggtaacatcaagcagattgccagaattaatgcggataacagattcatgtcgttggtgttgaatcctagttggaggactaataagcgtacgaactggtagagaatgctgccgagggtaaccgcaacgagccgttgattcaaggtcaattcaccaaagacaacttcaccgatgatgatcgaggcgagcgcaattacgatgattccgattcccatgctgacatcagcgtaaccgttattttgcgcaattaatgcgccgcccaggccaatgatgccgttagagaccatcaatcccatgatggtcatattatcggtgttgataccgattgaacgtgccatttcacgattgtcaccagtgacgatgaaggcttgaccgaggttagtctgcaagaagacaatcagaagcacggtaatgatactgattactacgaggccaacaaagacgctgtcaaagtacttaggtagtgattccaaaaagtgatttgaaaagatggtttgtttgccaagcagcgaaacgttggagctgccgcccataatgcgcaaattaatggataagcacgcggtcatcaccagaattccggctaagaggatcggcactttacctttggtgtaaagtaggccggtgaccaggccggtaatcgcgcccgcaatgaaggctaacagggaagcggtaacgggtcccattccatggctaatcgccatgacagccgtggccgcaccgagaggaaacgttccttcaacggtcatgtcagggaaatcaagaattcgaaatgtcaaaaacagtgcgacgcctaaggtagcccacaagaggccttggccgatgcttgatacgatcatactcatttgtaaataacccctttcgttttggcttccttaaggacacttgctgggaacttgatgccaagctttttagcttcacttaaattgatggtcatcttacccttagtgatgactttgattgggtagtcgctagttgctttgccctttaaaacttgggctgccatttcaccagttagtttaccaagttgatactggtcaacggataaggttgcgagcccgcccgctttaaccatcgtatcaacggctggaatgactggtaccttagccttatttgtaacggagactagcgttttcatggcacttgcgacgccattatcttgcggcgcataaacggcgtcgacattggcggccatggtttcagccacttgctgcatatcgttggtgttagagatagtatataacttgtatttcacaccttcttgtttacaaatccgtgcaaactttttggcgttatattcaccaccatgatctgaagtggtgtaaataatcccgattgttttagcactgggaacgagcttccgcaacaagtccaagtgggatttcaatggcgattcaccagaagtccccgtaatattggcgccgggatgctggtcgcttttaattaggccgctacccgatggatcagtaatccctgctaacataaccggagtctgcttgttggccgcagaagcgagggcctgcgcggcgggggtggcaattccgactgttaacgcggcattttcgttcatgaatttttggctcatggttttcaagttactttgatcgccctgggcattttgatagtcgatcttgaccgtcttgccatcgacataaccatattcctttaggccagcgactacgccacgatgaatcgcgtcgagtgcggggtgggtctggagttgaagaatgccgaccgtcggcactttctttgtactggtcgtcttcgtggcggtggttttgcctgtcatgacaaaggccactcccagaaagacgatcaaggcactaatgaatgcaatcatacgtttcaatctaatcacctcaaaaaatttcttaagctcgggcaagttcaaagccaataaaaaagggcaaaccagtaagctctggtttgccctttacggaaccgaagcctgctgtgttaaaacccatgcagacttctttgaatatcaaagtgagccggcacagatacaaactgtttgccagattgtatccgtgtggacggcattacaatctgaacggccggctttgccatgaactgttcaagttagtaattgactttgacatgcttggttcctcgctttcgttattgaatgaattcagtataggcaaagtcgaaaaaagtgtcaaggataaattttgccaaatattaaaatttgtggtgaaaaccttgtgaaatgcggatgcctggtcggctacatttatttgttctagtccgaccttcggggctgggtgccaattactggaacgcagccgacgtcgatttgagctaacgcccaacccgcgtcatctcaaatacgagtcttattctaagctagaagaaatacacttccgcctaagaataatttggcgtagcaagcgcaggcttcagtggtaccgagcacgtttcggaaagccgctcgaatggctgatgaacggccacttagcttggtgcaattggtcgtcgactattttgatactggaactttgaatgaaatatcaggtgcatgacctactttgtcgtaacattcaattttgactacagcggcttaagatagtgagctattccaatatcatttccagtctgatagttgcttagcaaaattactgtttatgaagaacaatgatgagaccaacaaaagttgggtgtgcacatgtcggccattcgaatcccatcccgactggaggtcggtgtaggacgaaccaaccaagcaggtttacactaatccgaaccgtttccagggggcctaagctggctgtctttgattttgggtattcagcaagttttaaataagcaggcaagtaaaacataacgaaaaacaataaaatgagttgacgatgaataaaactggtgttaaattagttttaaattaaaaacagattaaggcgttgaagagaagagtaatcgcatcactgatttgcagagagcttcgtaatggtgagagaagtattcaggagtgcggtgaagatgagcttggagtcatgatgcgggtcgtagtggctacgcatgcggcggcaaccgatatattgcggggtttcctaaatttttagggtactcgtcgaggttgtgatcgtgagatggcaacgaacaacggtggtaacgcgaaagctttcgtccgttagtttctaacatattagagactaatggacggaagtttttttgttttaaacaggagagaggaagcggttagatgacagtcacagcaaataatggtttattagcagcccgtggtgaatgggtgcgttcagcgcgtgaggaaggtcagcagacgcaacagattttgattttaaatttgatgccgactaaggtaacgacggagcggcagttcctaaagcgttttgcagccggaagcaccgatgtggcggtcacgtttatgtaccctgcgagccaccatttcaagagtttgccacaggccgtcgtcgccgcacattacgtcacgttggctgatattcaagatcagtattttgatggcttgatcgtcaccggcgcgccggtcgagacgttgccgtttgaagcggtcgattattggaacgaactattaacgattatagattgggcacaacagcacgttagccagaccttgtttgaatgctgggcggcacaagcaggactgtacgcccagtttggcatcactaagcgggccgtggatcacaaaattttcggtatttatagtgcgactagcactgacgttaagtcaccactgattaacggactgagtgctgggggcttactgaaaatgccacaatcacggcatacggcactggtgatgcctgaccgcttacctaatgggctgcaggtggttgctgacaatccggaggtgggaccactcgtcttgtccgcgcctcagcagcatgcggtctatgtgaccgggcaccctgaatacgaacggcgtacactggcggacgaatatttccgtgaccggcgtaagcatttgccaattcagttacctgaacattactttgctacagaacaattaactacggttgattacagttggcaagcggcgagcgaccagttgtatcaaaactggttagcaactttgaatttaacgaaagtaggttattaattatgacaacaacgaatcctgaaaattatcactttgaaacattacaagtccatgcaggccagacggttgatgaaacgggcgcacgtgccgttccaatctatcaaaccacttcatacgtctttaaagatgccaaacaagctgcgggccggtttgccctgactgacgctggaaacatctatacccggttgaccaatccaacgacggacgtggtcgacaaacgggtagccgctttggaacatgggacggccggcgtaacgctcgcaacgggttcggcggcgattaccgcggcaattttaaacattgcccaacagggagatgaaatcgtcgcggctaacaccttgtatggtggaacctatgacttattcagcgtgacgttaaagaagttgggcatcacgacgcacttcgtggatcctgatgaaccggcgaactttgaggcggcaatcaacgaccatacaaaggccttgtacgttgaaagtatcggcaatcccggcattaacttagttgactttgaggccatcgggaaaattgcccatgataacgggattatttttattgttgataatacttttggcacaccatacttagttcggccacttgaacatggcgctgacatggtcgtacactcagcaaccaaatttatcggcggacacgggacgaccatgggtggcgtgattgtcgaaggcggccaatttgactggcgtgcgagtggtaagtacccggactttacgacaccggatccacaatataacggcctggtttttgctgatttaggtggagctgcctttacgactaaggtgcgggcggaaacactgcgggataccggtgcaactatcagtccctttaattccttcttgttgctccagggtctagaatccttgtcattacgagtagaacgacacgttactaatacacgcaagattgtggccttcttaaaggcacatccgaaagttgcctggatcaattatcctgaacttgaagacagtccgtaccatgacctggcaactaagtacttcccacatggggtcggttcgatcttcaccttgggcttgactggtggcgaggctgctggtaaggccttgattgaacatctgcaattgttttcgttgttagccaacgtggccgatgccaaatcgttaattattcatccggcgtccaccacgcacgcacaattgaatgaagaggaattattggcggctggtgtaacgccggacttgattcgaatttcagtaggtgttgaaaacgcggacgacttgattgcggatttggatcaagctttggctcagatttaataactgcggaatagtcgatgattgaaagtaagtgaaacggagggtgctacaatgacaacgacaattgaagtgggcatgttagggttaggaaccgtgggtagcggggtggttgaacgactggcccgctcggctgccaaaattgaacaaacgcagggtattcggttgcacctagcagcagttgccgttaatcatttgaacgcacatcgtaccgttcagttaccgattggaacgcgtttgactgattcattaacgaacgtggtttgtgaccgaaaaatccaactggtcattgaagtcatggggacggtcgcaactgctaaaaaggccatcgtggcagcgcttaatcaaggtaaagctgtcgtgaccgctaataaagacttaattgcaacggccggacctgaattggctgcgttagcaaaaaaacggggctgcgatttattctatgaagccagcgttgcgggtggcattcctatcatacggacactgacggatagttacgtgacggataatgtgcagtcgatcagtgggattatcaacggaacagcgaattatatactaagcgcaatggcagccggccaatcatacgaacaagctttgactactgcccaggcagccgggtacgctgaagctgatccgaccaatgatgttgcgggcattgacgcggcgtataaattaatgattctcagtcgttttgcgttcggtcaggaactgagcttatctcagatcgcccccgtggggatcacccatttaagtgcttcgatttgtcaatcagccatggaaaatggttggcgcgttaaattgctggcgcagattcagcaacatggccctggtttgtactgccgtgtggcgccggtagccgtgccggtcaatcaacccctgagtcagatcaatggggtccaaaatgcggtagcagttcaaagtgaagccatcggtacgagcttgtataccggaccgggtgctggcagtacggcgacggcgaatagcgttctaaacgatgtcttagtagcggccaagcatctgatcagcggctgtcaaacgatccataaccaaaaagacgctggcacactagcagtcactcgatttgatcagttaacacaaacgtatttaggctttggtaaagttgcgcctcaagtcttgaagcgtcacgctgatgaagcggatttctcagttaaaacgattaccaacaattgttatcagattaccaacttaagcgccacgcaacgtgagaagctaagtgcggccctcccactgactttagtaccaattgccggtacagcggactggacacaggtggctgagaatccgatggcaaccaccgtgaatgttgcgatttgaaaaagaacgttcaggtacagtatactgtatctgagcgtcttttttctgatgctaatttcccatgggataaccagggttagtggacacgctaattgagatgagttagcgagacgtggcagcgatttggctggcacgatgaggagtgaaattatgaaaattgcggtggtgaccgaaagctctgccaatttaaaggcgcaagctgtgaaagactaccaaattacggtggtgaacgatccgattatgttcggtaatcacgtttatcacgaaaacgttgatattacgacggaccaattttatcgattgcttaaagttgaaaaagaaattccgacgatctctcaaatctcgatgccggagatgcaagttgtgttcgatcggttgcaagcggccgggtatgatcaaattttagtcattgggttgagtagtggcatcagtggctggattaataatttaaagacttatgcgccatcagtcgatggtattgacgtgcgggtgtttgattcacgaactgcttgtgccgggacggcaaacatggtgaagttggccgcagccatggcattggctggctacaccttagatgaaattattgcgcaattaacacgtttgcgggcagcaacgacaacggtcttgattgtcaactcgatgcgtcacctggttaagaatggccgaatttataataatagtagtttggccggaacgatggtgttacgcaataaaccgattattacgttcaatgagcatggaaaaatccaactcttaggtaaggaacggacgcttaaaaatgcgcaacaggccgttcaagatgaatttagtcaatttgtgacgaccagtcaattaccggttcgactggacgtcattagcgcgaatgacgcgcagattgccgaagactgggcaagcgagctacgctatcaatttccagctgtccgggtcaagaccggggttatcggtccagttttgggcgttttgaccggtgaccatgcgcttggtatgatctggtcattagattggaagccattactgacgacccttgatcaggaacgcggacaataggctgtttgaagcgtccttgtacggtttgctaatgatattaagcggtggcacgtcatatttcaaaaaaactttcgtgcaaaaggttgactttttcctaaaatgatattatggttataacattaaaacttgatgaaaagccataatgcttcaaggagtaactaacttgtgatgcgcagaaagcaccgctgctgtgaaggtgtgatgacaagttaggaaaagttgaaggattggcgtgaattttacgagattcactggtagcacccattattgtgcacgcgtttagtcgttttgaacgcgatgagtggccggatgtgaattcggttagcagtaaggtggtaccgcgcggaagcgccctttggataatctgatcgattattcaaagggcgcttttttcgtcaagtgacacatagcattactttaagcaacacatagcattattttaggtcggacatagcagagcaatcagtgttaacacatagttgtgcaacatacgtgacagcacatagcaaattgaaagcattaccccgtttgtgggcaaacacatttggacgggcgggggacacacatagttggcaagacgaaaggatggttttacttatgaaatatggcattattggtgcaggcgcaatgggatatcggtacggcgtaatgttacaagaaaacgccggagttgacgttgattttatcgacacgtgggaaccaaacgtcgcaaaggtccgtgagcagggcggcgttgatgtggcgcgtgatcatcaaaatcaccatgtcgttccaatcaatatttattatcctgaagaatatcagggtcatccagatgtttggattgtttttaagaagcaaatgcagttagccgatgagctcaagcgcgatgcgtcgttatttcatgaggaccagtacgttttcgccgcaatgaacgggatggggcactttgaaaagattgcacaatatttcccagaaaatcacattattggtggtacggcgatgattgcagcggtcttgaatggtccgggtgcggttgattttatggggcctaagggtagcgaggcgatgcatatgagtaagtatgcaggtccgattgatgcgactaccaagcaagtgatggccgattttaaaaccgctgatttaaatccaatttggtctgataactttatgggcatgtgtatgtccaaagttgtgttcaacgcggtcaccaatagtttgtgtacgatgttcgagattcaaatgggtcaattcatcgaatatccgggcgtcaaggatatggcgactcagatgtttaacgaagcctatgatgcttgcgaacgggcaggcatcaaactcattgagacgcggcaagaagagatcgattcggttgaaacggtcagtcgagcctataagtaccattatccatcaatgtatcaagacttctcaaagggacggccaaccgaagttgattatattaatggctatattgctaagattgggcgggaacatgactacgtttgtcgcgtgcatgagtttgtgactcacgaagtccatttagcagaaatgatgcggcaataccggcacccggaaatccccgttgctgaaaaataagattattaatgaaaaagttctgagtattttcagaactttttttgtgggcggaaaaaacttaatttagtaaggttgaaatcggtttctttgacattggtctatacacttaggtgaccttgtaaacttgcaatgaaaacatgttgtgataggatttataacgtgcttaaaaagagaacgaggagaaattggtatgaagacatattttcagaaaatcggtcagtcattgatgctaccgattgcaacgttgcccgcagcagcgattttggttgggattgggaattacttgccaaaacagtggttgtttgcaaattacttgattcagggtggtaacgttgtcctgaataacttagccttgctgtttgcagtcggcttagctatcgggatgtcagtcaataaggacggcgcggcagcgattgctggtttgatcgcgtttgaagttccggtgatggtgttaaaaccagcgacattagcgacgatgctgaatgttaaagtgagtcagatcaatccagcatttagcgcgttagataacaatgtgctgattggaatcagtgctggactgattgcggctgcgctctataatcggttccacgaagtaaaattaccaatggcgctctcattctttagtggtaaacgcctagtgccaattatggctgcttttgtgatgctgattgtgacggcggtattgtaccttgtttggccgtttgtctacgatgccatcgtcctctttgcaacggggatttcaaaattaggtttcgtgggggctggtctatatggctttttcaatcgtttattgatcccgactggtttgcaccacgccttaaattccgtattctggtataacgttgcggggatcaatgatattggcaatttctgggccagccatggtgttaaaggaatcacagggatgtatgaagctggattcttcccaattatgatgtttggcttgccagctggtgcgtatgcaatttatcgtaatgcacgaccggaacgaaaaaaagaagtgggttcattgatgttagctggtgcgtttgcgtcgttctttacgggggtgaccgaaccgctggaattttcattcatgttcgtggcatggccgctctacttattacatgccgtttttatgggactatcattaggattcgccgcgttaatgcactggaccgccagcttttcgtttagtggtgggttagtcgattatttattgagttttcggatgccgttagccaaccaaccctatatgttactggttcaagggctggtgatggccgtcatttattactttggttttgactttgcaatcaaacggtttaatttgaagacgcctggtcgtgaagttgtgtctgcggacgtcgatggggtggatgcacctgccagtccagcagtggccgttgcagcaacggatgataagtatatgcgccaagcaaagcaaatttatgcggctattggtggtcatgacaatattagtgtgatcaacaattgtacgacgcggctgcggttacaacttaaggatacccaaaaagtcgatcagccggccgtaatggctgctggcgtgcctggcttgaacgtactggatgttcataacattcacattgtgattggtacggaagtccagttcgtcgcggaggctctacaaaaattattttctggtcaggtggcgacgaccccggcacctgatgctgaatcaaaggccctggttgaaccgcaaactgctactgtaacggaagcgccggtgacaacgattttgcgggcaccggcaacgggacaattaatgccgattagtgcggttgcggatgagacgtttgctggtaaactcttaggtgatggttacgctgttgaacccgaagatggtgaagtcgttgctccggttagtgggacagtgaccagtgtctttccgaccaaacacgctatcggtttgaagacgacgagtggtctcgaagtcttgctacacatgggaatcaatactgtagaaatgaatggcacaccgttcacgttgcacgtggctacgggtgacgaaattgcggccggtactgcggtagcgacggttgacttggctgccatcaagtcagccggtaaagcgacaaccatgatggtcgttatcaccaatatggatcatgttaataaactaacccttaatccaactggtcgtgttactagcggtgatttgattggcgctgctgaataagttacgtgctaccgccgttgggtttattgaaaaagtgccacctaaatcgaaaagatttaggtggcaattttttggcattagttatcgtgtcaactggtgacagcaaatgaacaacttgatgcggggacagtgcgtttgattgcttcccactgactcccacgatatactattggcattataggggggcgataacatgattgacgaagtattagtattgaactcaacgccaacggggattttgcagaattcagtttcaggaagcatggtgatcgacgcggcacttgatgcacgactagtcaagcgattaacgaaagcgctaactcagtcaacgcttgaggttaaagttgcaaccgcggacgacttaccggtgaccggccgtcaattgctggtcgtcagtcgaccagtggcagccgtgttggacttacaggctagtgcgcaagtcctaatttatccagaagcaacgggactgaccgccgctggaatcacacagctagcagcgcagattgatcaacgattaatatccggataacgatccaaagacgcccagaggagctgttcaccaatttacgaacagttactctgggcgtcttcgtgacacgctttaatgatagttactaatttcaattaagttgttatcagggtcgcgaacatacagtgacgttaacttgccatgggcaccagttctttcaaccggcccggcaatcacatccacgaaataactctttaagtgatgctggatatcatcaatattatccttcgcaatcaagcaaagatctgcactaccgggtgtcggcttagccgcaatgggttggtgtggctggtcagtggtctgaaagttaattttttgtttacccactaagacagcttgacggtcaccatcgaaggtcacaatgggaaggtcaaatacttcatggtaaaaccgtaatgaccgtgcaatgtcagtaacggttagggtcaaatgatcgatatcgcgaatattcacaagctcaaatcccttcaaaaataaattcattattaaacatgttgtactcattaggcctggcatgaatcatgattaaaatatgccagttgtgtaagttcaaaaacggctagcttaggaccgctggaaacggttcggattagtgtaaacctgcttggttggttcgtcctacaccgacctccaggcatttctgccaattgccggaacgtggtgggcacagatttgagccgaaaaagcacgtctcaaatactggcctttcactaaccaagcaaagaacgcttgctaagtgaaatttcaccactgggcattgtcagaaacgccttccagtcgggatagtattcgaatggcagacatgtgcgtgcccaacatttggtggacttgtcattgttcttcataaacagtaattttgtcgatcaactgtcaggcagaaagtgacgttgagatagctccctatttcaacgtcaccgtagtaataatcgaacgtttcaacaaagtggttaacgtaaccctaacgtttcttttaaggttccatcatcaaaatagtcagcgaccaattgcatcaagctaagtggccgttcatcagccattcgagcggcttaccgactggaggggctgggtgacaatgctcagtagccaaattattcttaggcggaagtgattttcttccggcttagaataagactcgtatttgagatgacgcgggctatgcgttagctcaaatcgacgtcggcttacgttccagcaattgtcacccagccccggaggtcggaataggacgcgcaccggctgacgaacaggaatccaactaaatcaggcccgttttaatcatgattcatgccaataataatgagtataaggcgatgtaattcagtataccacgattgataatgggcggatgtggcagtatttgggaagtgactcaaaaaataacaactgtaaccgttcacaccgaacgcgacttttgacaatgcctgcttttcatagtaatgtaggtgttactataagaaggagggctattcgtgataacaattcgaccagccgatcaagacgacgcgggccagatagcaccgctaattaatatgatttttgatgaaatgcaacttgaggaactagacgacattcctgaacctgacttagagcaggccattactgctgcttaccggacacctgattatttgtctggtaaggcaacgacggtagtggccgaggccgatggtcaagtggtcggggtagcgtttggttatcctgacaaaaatgaggacgcggtggacgacgtgttagcacgagttactgcgaataatgatgcgtttggttcagcatttgaagctgaagcagaaagttatgagcacgaatggtacctggattcgattgcggtcgacccgaattatcagggtcatgggattggcgggaagttactcgccgccctgccaagatatgcacgacaagctggtcaaaagcggattggtttgaacgttgacatggctaatttaggagcgaagaagctctatgaccgttatcattacgaatcggtagggattaagcctatcggtgatcggatgtacttccatatgcaatatgaactagataaagacttggtgctagcttagtatcagggctatcgcaacgggcctcgtgacatgacggggcccgttttaatacggggcaaaatgaaagtgtaggttgaaaacaacatggctttactagaagtaacggatttatcgcaaagctttgcggaccgtaaattatatgaagatgccaattttacgctggaacgcgcggatcacatgggcatcgttggtcaaaatggggcgggtaagagtaccctaattaagattttaactggtcagatcttaccattatctggtcagattaaatggcagcgcaacgtgcgtactggctacctggatcaatacgctgatattccagccggtatgacgctatacgcctttttgaagacggcttttcagcgtttgtatgatttggatgcgcagatgcaacaactttatgcggattatgctgaaaagatggatgaccagttattggaacgggcaggtcggattcaggagaccttggaagccaataatttttatgatattgagacggaaatggaacgggtaattaccggtctaggattagatgaaatcggtcgggatcacgtcatcagtgagatgtctggtggtcaacggtcgaagattatcttggcgaaactattgctggaaaatccagatgtgattattcttgatgaaccgacgaactatctcgatacggcgcatatcagttggctggaggattatctgaacggctttgaaggggccgttatggtgatttctcatgactatgattttttgcaacaggtcaccaactgtatttgtgacgtggcattcggcaaaatcattaagtatcggggtgattttaagtcggctatgcggcaaaaagaagcgcgtaaggaagcccaactgaaggcgtttgaaaagcaacaagttgtgattgaaaaagccgaaaagttcattcgtaagaacaaggctggctccaagtcaacgatggcgaagtcacgggaaaagatgctatcgcatttggatcgggttgatccaccgagtgaaaatgaacacgccaagtttgcctttccataccttgatacgggttctcaaaatgcattgagtgtgacgaagctgtctgttgggtacggaaagccgttgttggaacccgtgacttttacgatgaccaacggtgaaaaattagcgtttaagggctttaatggggttggtaaatcaactttgatcaagtcaattttaggtgtaattccagcgttaagtggtaagtcagatttttcgccatctgctaaaatcaattatttcaatcaagatttggaatgggataacccacagttgacaccgttacagacgattcaaaatgaataccctacgatgttaccgaagacaattcggactaagttggctaagtgtgggattaatgcggcgaatgcgatgaagcccatgcacttactcagtgggggcgaacagactaaggttaaattagccttgcttgaattggttccaagtaacttcttaattatggacgaaccaacgaaccatttggacgatgaaactaaagaaggcctcaagcgtgcattgcaggctttccaaggtaatctaatcttggttagtcatgagagcagttttgtgaatggctgggtcgacaaggaattgaacgtcgagaaactcagtttgaaagaacgacaaggctaattcttatcctttttaatagcagtccatgcttgggcttgtctgtggacagacattcaagcatggactgtttttggatgtcctgattaggagaaaattatttttagctgactagttaatttgaaaatggactgctggcgattcagtaattattggaccgtcagcgcgccattgtccccatcggtaatcgctaaaccccaaaaggccgttaatttgtaaatcgggaacgaatttacaaattaacggccttttgggaacaattattaatccgttagtaattgactttcaaccgtggtctggtcgcgaccggcctgcttggactgatagaggtagtcgtcaacgcggacgaaccaatcagtgaaagtctggtcggttggttgcaattctgaaataccaattgaaacggtcacgttcaacgtttgagcgttaaatttgattggcactgttttcagtttacgctgaatcgtacgcattatttgaccagtttcaagcgctgagatgccacgaaaaatgatgacgaattcttcaccgccatagcggaagatctgaccgtgagtgctgcgctgattaagttcaagttcaacaaaatgcgccacgtgtcggagtacggcgtcgccagccagatggccgtactgatcgttaaaggctttaaagtggtcattatcgaacatgaccatagtgacgggccccatttgatggtgctgatacgcggcaaacacttcacgcgcatgcgtgtcaaagctggcgcggttacgaataccggttaattcatcgtaattgacttgttgatcaaaggtgagcacttcattgaaaaacttttggacgcgattgactgctaaacgaatcaaccacatgtaaaggacaaaggctagaatgatgacgagtgtatggctcaatttgaacggatgaactgaccaaataacgccccaccaagtgccactatatagtatttggaacaggagatacttccattgaatagcgtgtaattcttgatagttatgagtaatatagacgactgtactaatcaagataatggccatggccagaaaaactggcaggtactgcgtgctgtggcccaaccagatggcctgaccataaatgaacaatggcattaacaggttaataatttcaacggccaggttgcgcatggtgttaaggctgaacagaagaatcgttaattgaaccgttgcgtaggtccaactgataatgctacctgaattcagcgtaatgaatatttgtcgtaataggatcatactaatgaggacacttaaagcctcggcaccatgggccacaatagtccaatatcgattttgacgacgatggacctgttgctctaggaggtaggtcagaatggtcattagggtgatcaggccaattgtaatgagaacgacaattagcattttgatattaaaaagatctcggcctaagctcgatagcgtaagtagatgtaacacagtgcgcccccataattgttgcgtttaattaatttgtcctttaatcataacacgttacgcaggtaactgttaacagcagcttgcaataatttaaaaatcatcaaacagtctttactgaaaaataacctagtctttacataaatatgatgatgatttaggcctcaatacggcatacttgccatgtaaggttagatagcaaacgcaataaaaaggagtttgtaaaatgctgcatggaacgttctatggtgtgatcttgattagtttcttgattggtatcggcgtgcagtggtattttcgtgaatactttcaattattagtgttcggccatagtgttgagattttatttatgatggtattaggttggtaccagttcggcatgctcgttttactaccgctgttagttttatggggaattggacttggtgcaatttatgtgatgaaccgattcgcgtaattagtttgtgtcgtggaggtgcccaatgagacgatggtttgtgagttacacgctaggaatgattgttggtgcggtgttatttttgtgtagtttagttgccattcattggttgggaccacaattatgggtgggcgtggctttaggtgggagtctattggtaggttgtaatattggcttagaagttctcaagcgtcattatcaagtgacgacaccacaagcgatttttaggttattgaattggtcctgaggtgcccataactgatagttgggtttgatttgaagcgggctaccgatctctgatattgcaattggaattcattaaataggcgcaccgagaaactaacatggtttctcggtgcgcctattaagctacagtttccctgtgcatgcggattaatgattgattttagacatgtcatgatcatcgggcaacgtgaggccacggttagggacacttgttgaaaagacgatctgagtactcgtttttccaaatgtttgtaattggttgacaaactcgtctaatgcctgcgttgattcgaaaatcactttcaaaatttgagagtattcacccgtgacacagtcacattccagaatattaggaatgccggcaacaaatgggtaaaagcgctccttttgcgttggttcaagttggagttgaatataggcttttatgtggtaattgagcttttcaaagttaagatttgcttgatagtcacgaatgatgccactctttttcagacgagtgatgcgagcggaaattgcgggcgaagaaatgaagcattgatcggcgagcgcttttaaggagattcgcgcgtcggcctgcaaggcgttcaaaatcttcaaatcggttttatccatcgttaaaacgcctcctaagtaattattagtatcatagcatactttcacagtgatttttaatatttagtgtaaagtttctactgaaaggatagcttcttaacgtgccgaggtgccacggcggtgtggggcgatcgattaaagttaaaatcacttcaaggtttgaccaggaagccagacgtggttccggagatatggtaaactgaaaaaatgaggtgactagaatgcaatcaacacggatcattgcggccgttgcgaacgtgtggcggcagccaaacaatacgtccatcgatactccggcactagcaaatgtcggcttacaaccatggttggcgcagttatcagatgaagatactgtggctttggaacgcgacaatcgcatcgtgacgcaggcgttatttaacgacgtctttttagtcgaacagtttgtcaatggctgggcctatggttacgttgttaatcaggccgactcccggcatccacaggggtatccaggatgggtatgggcggcgcaattgtcgaccgtcccattgccggttcaaactgggccgatgattacgatacggcgtggttttacgccgttactacgcttagatggccgtacgttcttaaatcttagccttggaacggaactacccgttattagtagcaaagatcatcgttattatacggtccagaccccactcggaacgggcaaaattgtaaaacgtgcgacgcagtttgcatttagaaccgcgcgcttgacaccgggagcgacactcgttcgactcggtgaagaattcttggatttacgctacctatggggtggcatcagtgcttatggtttcgattgttctggattcgtctataccttgcatcgcagtctaggtatttgcttaccgcgcgatgctcaggatcagatcaagcaaggagtggcggtcgacttagcaaatgcccagcttggggatctgtgtttctttgctcatgatcatgggaacggtgcggtacaccacgttgccctatatgccggtgatggctggctattacatgcacccacgcctggcaaacacgtgacatacttgcagttagcaagcacttatttacaagacgagttggtcgctgtcaaacgaaattggtaatgtgagttcaactgacctagatttaattaaagtagaatatttcaaaatattaatggggcggataaagtgaaacaaattaaatggtggctgttggcagtcttattagtcgttggcttaactggttgtggttctcaaaccactaagcaacaagcaacgcaacgggcggcaagtactaaaaaaatatcgccgtatgtgaatcaacagacccccacattttacgtccacgggtttcaggggagtgcgaagtcaacgaataccctgattgcgcatgctgaaaagactgctcatgctcacaaagttttggtggcaacggtcagtaccagtggtcaagtgacgttgacgggtaaatggcgtggtcgggtgcgtaacccgataattcaagtcgtgttcaagaacaatctggcccagtatgaccaacagagtgcttggctggctaaggtgattaccacggttcaacaacagcacgcgtttaaacattatagtatcgtcgcacattctgcgggctgtgtcgctagcgttaatatgctgatgacgcaacaaacgacgacttttccgaagatcaataagttagtaacgatcgctggcccgtttgatggggtggtcggggaagatgatgttgctaatcagaactcgtttctgacttctgggcaaccgaaatatttgcatgcagcctatgaattattggcagccaagcggaacaattttcctaaaaatgtgcaactattgaatatcgtgggaaccttgaacgatggtagtcattcggacagcttggtcaccaacgtgtcggcccgttccatcaagtatttattgcgtgggcgggatgtcgattacaccgaaaaagacttttatggggcccatgcacagcacagccagttacatgaaaatgctaaggtagcactggcagttgaccgctttttatggcatcgatgatatgactgagtctctgctaatcagtagttggtttgggattgtgagtcagtcacgttacgcaattagaatcaaaatcaaacaagctcatccggccttagtcaggtcagatgagcttgtttgatgatcgttatcctgaagtcagcgggttggtctgggctagagaaagaatagaatataagccgttcgaataaggtggtacaacgcatatagggtaatcaaataaacaactgagataccgccatatacggcatatttataattgcgcatgtaaaaacctcccttataaaattacctttagtgtaaatcggaatctgtttttacacaatgcaaacgccttcattattagggctaaatttaaattaagtcaaagaaagagcattctgttagcgataacttcaaaaatatgataaagttaattgttagttcggtggacttcacgctgccggattaaatttacctcagattttggataaattaatttttagtatcatgtacttgccccagtattgagtattagaattatttacagatttcctgagcattaggaaaggatgtaattcaatgcgcgttaccattaatcgcggtcaagaggtctacactgatattcccttaatgaccgcccgacatcgctatatcaaagcggatgtctgggaaataaaaaaagcaattattgaaaagtcggccattaacgggtggacggttcaagcgctacaagcaatgaattaaaaaataaacaacggccacggcatttgccagtggccgtttttgtaggaggacgatttgaatggcgcatgaagtcagttatcggccattaatcagtattacgaacgtaatctggagtttcgatgcagtgaccaagcaactgctggtcctgcttattcagcgtgatcacgctccttttgagaatacctggggattaccgacgacgtatttgagaacggatgagagtgcggatgaagccgcattgcgattagttcgtgagaagttgggcgtccagcttgcccaattccatacagaacagttagggacgtttaccgcggtcgatcgcgtgccgggtgaacgctcactggcgttgacgtatatggtttatttgccagtcaagccggaactagttccggggtatggtgcgcgcgatgtcaagtggtttgccattacgccgcgggtggatcgcgatgatctggtcgctgatggtttggcatttgctggtgttcccgattcgcagacggagcgggagttttatcaacgaatcaccaagcagttgttaaccgccgatcatggcctgatcttaagaaacgccctacaacgtgtgcgcaatcgcctggactatgctcctacgatcttattagtgttaggtgagcagttcacactcaaacaggcgcgccagctgtatgcgattttgtggcggcagccagtggcaactatcgacaattcaaactttcgtaaaacccacgttcatttatttacagaggtggggacagcccgacctggctcttctggacgccccgctaaggtataccggctaaagtagttcatttgacacgtccaagtcggtatgctacttttatagcaccataaaggtaaaaaatacctaaattagcggaaggctaattaggaaatttgggggagtattggaatggtcgaaagtaaaagaaatagtgctaagctattatgggtcatcgggacggcctggctttttgatgcgttagacgtggccctgctatcatttgtgatgccggttattaaagaaagttggcagctaactgcaggacagttgggagcagtcagtgcgatcaccacgcttggcatgatgattggggccttggtatgcggctatttagcagataaattggggcgtaagccggtcctcattgggacgctactgctcttttcgcttggtaatttgttattgacgattaccccgaacgtcgagtggttcttagtcgttcggttgttgactggcattggtctggggggtgaactaccggttgctgcgacaatgattgctgatcattatacgggaacacagcgctcacgcatgctagtcctggtagatagtttttgggcgtttggttggattgcagcatcgttattggcctttttagtgatgccacacattggttggcggatgacggtcttaatcaccgccttaatggggttgtatgcgttgctgttacgccgacacttacctgcagaacaggaggctaatcggtcacaaaaagttgattttagacaggcattgcggcaagtgtggtccgctaaatatcgacgagctacgatttgcctcagcattctatggtttgtgattatgtttgcctattacggtatgtttttatggcttccaagcgttttggtgttgcgcggattttcattagtacatgggtttggctatacgatgttgatgagcttggcgcaacttcccggctattatctagctgcgtggttgatcggcgtcgtcaagcgtaaggcggtattggcaacttatctgattgggacggtcgtcagtgccgcagcttttgggacggccaataatccaacgatgattctgattagtggtgcatggttgtcgttctttacgctaggggcgtggggaattatgattgctttcacaccggggcaatttgcgcccgcggtacggggaattggtatgggcgttgcccagtcaattggccgcattggcgcaaccatcggcccatttttagttggtgcgctgatggcaattggatttggcattccggcaatttttatggtgttcgtggccgtactcttactcggtgttggggtattgctattcgggttaccgaatcaagagacggatgattaagtatcggtggcagatataaattaaatcgtaagttaaatttacttatatggaatggactagtgatgtgggcgctgttgctgaatttgaattgaaatgattcaataatattttttgtgaaagttaaacgagctcagtgatgacgcggctttgagggtgtcatttgttgcgaagccaaagtgaaactcctatgattacactgaggagttgaaaaaaatggcaaaggcaaaagcacgtacgacccaaccgaatgaacgattaagtgcccaactagcacttgccagcatggcaattgagattcgaagcgatgttgtgttgaccaggttagttgcgcgggctcgtcgccggcttaatagtagtggtgacagtattgctatcgcgcaccaaatcgctgttgatctaggttattatttagtgtgtcatcaatacaaaatgccccgagctgcttatgatttgttggcagttgcgtatgaagtaagtgttgagacgcccacacgagcgactattattcagttaccgtcacgaaaaaaatagactaggactatcaattgattcacacttatattagaatataatgataaatagatgtgcaaaattggagggaattgaatgggaaggtctgaacaattaaaaaagctcgtcttggcagggttatttgccgccattatttttattggtatcagtgtattacgaattccgttgcccgcgattgttgggcggccatttattcattttggtaatattttgacagtgctcgcagtgatgctgcttggttttggctatggtgctacggctggtgcagtggggcttggcttgtttgatattctgaatgggtatgccgcaacttcgtggttaacaattattgaagcaattattctggccgcgatggtcaacctgagtttcaagtcaatcggctatcgtgaagatcgtatcggccggctttactgggtatcgttagtcgcagggctcacaaaaatcgtcacttcgtggtgtacaggcgtgattgaggccttaatggtgggaacaacgctcaaggttgccatgatcgggtccttcacgagtttattagcagcgaccattaatgcggtggcatgtgtcatcattgtgccgttattgtatcggatcttagtacaggttgggtttaaccgccagcgggtcggtacggtctaaatggccgcatgctaacgcagctggattagtgccgtgagcacttattattttaacagactggttgcaatccactttaacaccgttggctgtggcgtttataattattggacagattttggttgatcaggttaaccatggttgtattatcggtaaaaaaaataccaaaaaggcccgggttagcgtacccgagcctttcttgtaccatataaaaaaccatttaccaactaacgcctaacttcactagtaccaaccgcaaaacattttcgtcttggcagttacctttttaacacctgaacaacttcgaatgcagcaatcgactattattttctagatagattattctagtcattcagccaatcgtcaaacttaggcttagccactggcaagacattagcaccgattttaatactttcagataacaaccggaaaagtcagctgtcataattgtttcatgacaaagtaactagcacaacgcgtattggatataaatacataaagctgactgcatagtcgactttataccgttgcgggcaaattattacggttttagtgaacttgcataaaatagtttggaccaggtactggattgtcagcctcaaagtaaagaagaccatggaaggcggcgtggtaaggaccgccacttggagttgctgtaaaatactgtgccacagtgcttagatcaggacgatcagtaatgtaacccgtaaaagcaccctttttttctgaaaagctaacgttcttagcgtttccagttacaccacccatatatctgccatagcgcattcttgaaccagaaaatttatttacttggcaagattgccctttacccaaccgcttgacggttgttggttgtttcgggccccggtcttcgataactggttcttgagatgatgcatcaaatagtggaacctgattgccatccttgtcataaatcacgttttgttcagttgtaacgctttgctctgtaaaagtactcgagttggcatttataacatggaaaaaaattgacacaatcagccctacagccgataacgatagtgcacgtaacacagttaaactaccccttttcataatacgtttcccagtttttaccggtattatactttgtccttatatgatagcatgagataatcatatgtcatctattttttcagatatttagctttaacatattgggctaaacagatctaaggagatatccaatactacaatgatcacaaacttgatggcggcatatttgaccatgagtgcttttgcattagtccataatgcagttgctaaaaattcgatgtgtacttttttcgacatcagctgaacttaccagaagtatcttaaatccaaataaaaatcgcgcccccaagacgcggtttttcgtcttggaagcgcgataatatgattaccagtaattacttaccagctttcatctgaatttcagcctcggctggaacttgcatatcgtgttgcttgaggaagaccatggaagcccacagtaagcccagcgacacaatcgtaattcctgctaagacaacgattgatgaccagaagataccactaccccaaccaccagttaaggcttgccggaacgcttgaatcgagtacgttaatggcaagtacgggtgaataacgttgaagaacttgttggtaatttccattgggaatgtcccaccagaaccaccaagttgtagcatcaagataaccattgcgacgaaccgtcctgggttatcgaatagcatcgataagaacatgactaggaacattgacgctaaggcaatcatgattgccgtcaagtagtattcaggtacactgattggtttcaaaccagcaactaataacactgtcgcttcgatgaccgccatcgcaagtgctacgggaccaccaacggcaactttactccagaaccattgtgttggcgtgccgtcgtcatccgcaatccgtcgaattggataagcgaagttgaagacgattgccccaacatacaaggccagtgacaagacgtaaggtgctaacgcatgaccatagtttggcacgtgcgtgtagtctttataggacgtcttagttggcgccgccatcattttcgcattcgcgttctttaatggtgtcgcgttaacttgatcagcaccttcttgtaaggaagtcgcgagtgtcttgttaccgttcttgatctgctttgtcccggataggagtttagcagagttgttgtcaagctggatggcaccgtcatttaattgactgacaccactcgttaattgaccggtactaccttgtaaggtttgtaaaccactgtttagttgaccggcaccggtgtcaagttgttggacaccacttactaggactggtacttgaccgtttaacgttactaaaccatttgtgaccttacttgaaccggcaaagagttgttgaacaccactagccagaactggcacttgtccattaagggtaactaaaccagttgttaccttgccagagccaacttgcaactgttggacaccactaactaactcaggaagttgaccattcatagttaccaacccagtcgtaattttgttagaaccaactagtaattgactaactccaccttgtgctgtgttaataccattagtgagggtttgagaaccagtactcaatttatttataccggtaatcattgcgggaacactgccgttgactgtcttcaatccacccgtgaccgtttgggaaccactaaacaactgctcgacacctgaaaccaatgttggaattccactattcagttgcgcagcaccagtcgccagttgtgtggtaccttggttcagatgacttgaattagcatttagttgctggccaccattactcaattggcctattgcgccagtaattcctggaaccgcacccttaagtgtggtgagtccagtgctcaaattattagcacctttattcagcagagctgactgtgaagccaatttacttgtacctgttgataacgactcaatcccactaactaatccagggactttcatatttaattctgtcaatccattgcttaaaccatcagtcccactttgcagcttcttcagcccagtggttaattgttctgagccactggcaagttgactaattcctgaagtcgtggaactaatgtctgaaataatggtattcatcccagcttcaatctttccgtactcggttactaagtcagcattagacttacttgttgccgaggtgttctccgcaactaatgactctacctttgataggctgctctgcaaattttgaacttgttgcgcattagtagtagtcgtcgtgctttgtccaacatcttttagactttccttaattgccgccacctgggtatcagttaaattctgtgacgactttaaaccatcgattttactattgatttgtgacgtaatatcagcttgcgttggcgacttggaaatacttaaagcatccacgttacttgataaggattttaacgcgctatttaaagcatcgttattattactactcttcgtgttagcagcaatttctttttgactagctgccaatgcctgttcaaattgtgccatttcagtcttcaaagtttcgatttttgtcttagtcgctgaatcatttactgcgactgacaattgatccagtccatcagaaattttcgcactatttgtttgtaaatcgctaacaccggcattgactgtttgcgcaccggttgttaaatcgttaacagaactgctcaaattagtagtatttgatttcaataggctggcacctttcttagcagtgccaacaccagctgtataatctgcaattccactggtcaatttcgttgagccatctgaaagttgcgaaacactattagacaattttccagttttaccatctagttcagttaaaccagtcgtcagctgataaacaccatcagtatatgtggcaactccgactttgaccttttgggatccatcttctaaccgtccagttgcatcactgattgtcccggttttgtcatttaaattttttagtccagtcgtaaccttgcttgaaccatctgtcaacaaattaacagcactagccaatgtcccggctttattgcctaatgttaacaatccttcggtaatcgactgcgatccaatctgcattgtcggtaattttgagtcaagttgttgtagaccattagaaacttgagctgagccgtttgtcaattgactgacaccactcaccattgggacgacttttccttgcaacgtagtcagcccagttgtgacttgactggaaccatctttcaactgactgacaccactagccaacgccccagtcttaccattcaacgtcccaagtccactagtaacttgcccggaaccatctgataactgactgacaccactagctaatgccccagtcttactattcaacgtatccagaccggtcttcaacgcactaccaccatcagcaagcttagcaatcccagcaggtaattgctgcactttcgtattcagctcagtcgtcccgttcttcaacgtatgaacacccgtcgtatacgtcgtcaagccatcctgcagttcaacgccaccatctttaagcttggtagccccatcggcggctttttgatagcccttaccggcagtccgaatctgcttgaatattgctaatgcgtaggctttagtgacttgcgcccgaatactcttattaactcgtgaaacaccagtatcggtaatgactttagcaatatagttcaacgattcgttggtctcataatgcaagttcatctttttcggattggtatccgtcatcgttgtggcattttttgagaaattgctaggaatcgtgacgaccgtgtaatatttccggtctttcaatccctgcttggcttttttagccgacacaaagtgccaatccaaatcgttatttttctttaaattcgtcacgacttgcttaccaactgcaaacttttcgccttgatagttcactgacttatcttcattaacgacagccactggtaagttttgcgtatccccatatggatcccacaccgacttcaagaagaagatgctgtataaaaacgggatcaaaatcatgactgaaactgaaatccatagtattttgctatgacgaattgaccgccattcgtcgcgtatcattttcacaacctgaaaccttccttcaaataattaaactgtatgttgctcaagtgaaaacaccgtcgcaagcgtcccctgaatcatcgcctgcgtgctggccgcctgaccatcacgatgaccgttattgagccactggacaatacttgtgacgaccccactgactaagtacgccgtcaaatcgggatgctgcgactggcgaatcatcgcaaaaacccgatcatccgcacccgtctcggcgaccgtgacaaaacagtcattgatcacttgttgagaacgggtattgtcaccctcattgttcgtcactaataaatgtcgtaaaacttgcgtgtgcgccccgataaacgtcgacataattgccgaaccaaccgtatcagttcgctcagcagccaatagttcatctaacgtgtgcatcaccatctgcctgagcaaatcaaatttatccgtataataacgataaaaactactgcgatgtataaatgcttgcttacagatctgctcaaccgtaatttgtgagattgaacgttgctccaacaattggtacatcgcccgctgtaaatccagctccgtacgaattgaaattaccatcaccccgtttttgaattcttatattcgaatagaagaatatagttgccataaaaacaccgctgcatccccgtgcaacgattgctggtgttcatgcagtttagtgcaagtacggtttcaattccaagtccgccttaagcgtgtgaatcaaatgctcaacttgcgttagtggcgcgtcaaacgtcacccgataatagttacgggtcccctgatgttcaactgcgacaaagtgtcgttcctttaacgtcttcaattgatgcgaaacggccggttgcgaaatatgcatccgttcagttaattcaccaacagtcatgccctgcgcgtgttgcgaaagttcaatcatgatttgttgacgccgttcatcggctaagacttcaaagatcggaattgtttctcgaaattcttgcagtgcttcttcactactgaccatgcgattagcctcctatattcttatattctaatgttcgaatgtatcaatgataaaactttttgaatccgtttgcaacacctaaattcactttgtcgataaacgcgacaaattattatttttgtcgcatttgacgcaaaaaaaaagacgcctgaccacgcgtcagacgtctccaagggtaattagtactagcaatcaaaacgattgatagcaacgtccggttgggagccggagccgttgtatggaaaatcataggtgtttgggaagtccccatgatctaagacatcgcgttacttgttaataatgacagaaacatcagcaaattaacggcggttaagtaactcgaataactacagtataatcgctcagtgaaactttgctagtcctactttgaaccttttgtcgtaaaacaggacatttagattaaattgttgtatgaaacaacgacgtttaacagtcggccgtgcccattatgctgaactagatgactgtcttgccgcttaattcaacgccttcttcacatatttgtaaccatacttaaccaactcgtgctcgacttgcttactagtggtcgtcgattgagacgaacgactcgtactcgtattctgactactgctgactttatcagccccagcaacctgcatcgtcgaatccgctttcccacgaccagtagcatagtcgaaactaacgccaggttcaacgttccaaatatagacattgaaattgacactgccatcggttgaaactgcttgcgaccagtaaccacgaggcatcaattcgttgccacggaaaaccgtcgtcacacgataaatgacttttttaccttgttctaacgccgtgcgcacctgatcttcataaatctgcatcgttttttgattcgagtaggccgtctgagttgccaagttcttcgggttatctaagctaccatcttcaccagcgcgatactgcccgttagacgtcaagttaaaggataacgtgtaagcaatcaagtgcccgcgattttgcggatagacccgcttaccattaacggtaatcggttgattatgccagccagttgggctccacgtttgcgccgtccgtccttcagaccgtcctaaattggccttactcaaataagccgtgtccgtggttgtccgattcaatgaatctaaattaccgtaatcaatcttagaatttttccactgactcgctgccagcgtactcttaccgctattaactttgatggccgcagcactgcccgattgataagtcatttttgccagttgtttgtaagtttgttgtgtattaccagtcgtactggtcgtttgattacgactggattcagactgctgactagtcgtcgaactcgtcgtatccgtaccagacgttaacaagctacaaccacccaacagtaagctcaaactcaagagacccgctatgccaacgcgtcgcattaatttcaccatgattctctttcaccccgtcttttttaagtacggttctatcataccgtactttcacaaggggaacaaacgttttcttttaatctttttgtacttgccagtcattccttataatcccatacttgaccgagtcataatactgcccttgccaataacgaacttgtggaatccgagcctcctgctttaatcccacggcttccgctaaccgcatcatccgcgtattccccgaccacgttgtcaatccaatgtgcggcaaagtcgtctcctcttggaataagtgggtcaaccatttagtcaacgcggtgcgcccaatatgctcaccccaatgctcctgattatagataatgatgcctacctctaaccagcgtttgagggaaccatccacaaagtgccaattaacactgccgacaatcacaccatcccgtgtgatgacccagttacgcggtcgaatcaaccaatcacgggggccaataattgtctcaaagtctgtttgagtcggtagttggtcatgaaaatacggtccattccagcgcatccactccgcatttggatcactaaaacctagttgccatagcgtcgttaattctgcgcgctgaagcggtcgaattgtaattgttgccgtcatttgatcacgccctctcaattcataggtctactctatcgaaaaaccaccctaacaacaatcacattcgtggacatataaacttacattaaacggccccttttccagcgaaccgaagctggccgtccttgactttagctcacttagggacaacgacagctaaaaaaccaccattctggctgaaagaatggtggtcataagtcttaagcgtgtgttgcaagctgtcgcaacaattttagtatagctgctgaaacgcgtttcaggtcaagcactaagttggcgccaggttgctttggtcagtaagtaccgcatgacgtggatcacttcacctttatcactggtaaacgtgtgcagttctccagccgcttgcatgcccatcttagccatcactcggccagaattagggttggcactcgcatagtgagcctcgatggtctcatagttcagcgtttcaaacccataatgcatcaaacaattgccggcttccgcaacataaccgtgcccccacgcagctgggcttaaagcgtacgtcaattcaccagtcgcaccactaccatgaaactcataaaacccaatcagttgatgatcacggcgacgttcaatgccaaaaacagtggtcgtgtctgccaaaaagtgcgtcgtaaacagttgctcgaacgcggccggactctgaacccggcggtaacgtaaataagcgacaacctgcggatcaaaaatcatgtccgctaacgcatcatgatccgccgctgtcattggtcgtaatatcaaccgttccgtttcaaactgagtcaaattgccatctccaaattattattgattcgttaattataataatctactggcaaatgtaaattatttcgttccactctcaatgatttggcaaagtcacctgtgccagcatcgcagttcctaccgcttcaaatcgggggtcagtaatctgattaacgtacgtaaatatcccagtactacattgtaacagtaaccactgtgtcactaatggtggtatttgtaagtctgtcccataaccagcccaaaaagcttgaatcaacgttgcagattgttgaagatcttcaaaaaagaatttcaaacagtcctcgagggcgtacccgtgacgggctcgttcaaaatcaatcagaacaagctgaccatgatggtagcgaaagttacgagtacccatgtccccatgcagtgtcatgactggttgcggtgctagtgcggttttaatcatcgtccggtggtcgagaaagtatggtaataaggacaccagcgcgtcgtaatgggaactagtctttaaccgctcgacccgggcgaccatcccatcgaaatccagaaccggcatcaggtctgcggttgttggaagttgaattgcgtggtgaaacctggagactacctgacccatttggtaaacgagcgccggagtcaaagttgtcggtacaggagttagttgccagtctcgcaacaccaacacccactcgcgacttgctaattgaaaactggctaagacccggtctgtgagttgcgctgtcacttgctgctcagttctaaatttacgttcgcgattcagactgaaaactttaacaaaaactacggtgccatagcggcgactatagccggtatacatctcattaaatgaaacatgcgcaatcggaatcaagtctgcctgtaataaccgtgttaacgttttatgcagcgttctcatttcgccctcctaaatccaattctcgcaaattttaaccacaataaaagggccggtaaccaaccgtccctttctctgatcgacttgcaaaccccaagcttgccattgtgtatgtgcctcgtcatggacccagcccatcccgagaggtataaatgcttgtcaaacgttatgattcagctaactgagctacttatcactatcaataattgcttattaacaatgtcctgacaaagtaaatcgatccggctcccaacctaaatccgctgacaaagcgtatgtattgcttcataactttgtctttagtatagcgagccagcattgcgtttagataacacgaagattacaaaaatgttacaactggtctaaaccaactaaaagttagcctggtattgcttaatcgtctctggctacggacacccagtttatctttaacgaacaaagtcacccactatggccttaacagtcggcctttattgagctaaaagccgttgattgacatgtgcttgaataacttgtcgccgagaaccggtcaagaaataaatcgttatgccaacaaaaataatgacggtagcaccgattgtttgccattcgaacgcatctggcttaaccattgtctggctacctgatgccatcatgctcaaaatatcaatagcagcatggatcaccatcggcagcaagatactacctgagtataggtacgtcgaggctaaaaaccagcctagtgtcgctgcaaaaatgatttgctcaaccgtggctgacaagggttggcccgcaaaaacgtttgtaatatgccacattccaaataggccaccgcttagccacactgcccagtcgatctggtaacgccgatgccgaaaagcttgtaataacaaggttaaaacggcaaaacgatacaaccattcctccgcgattcccggttctaacccactcaaaaacattttccaagtcgctgaccgtagctggaagtcccaatgtgtgaacgttgtcgcccatgaaccacccgcactaaaggcattccatagactaaaagccgttcccaccacgatcagcccaaccactaaactagtttgggcctgacgattaaaccgccacgatgggcccgtcaatccccatccccgcagtaagaccccaacagcaatcacaaagcccagggcgcctaaaataccagtatcactgaccatctcgaatactgatggtgcttgcagattcggtaaaatcaaaaaagtctgctgcgcactgacgacaccactaaaaatagccgtaattaggaccgcaatccggccaatcacagattcgatcggtttagtgaccaccactgccaccggtacgaatgcgaccattaaataagccatccccacagcaatcaatccctgctcgtctaaccatgacagctgacttaaccaagccacgaggattgccagtaaaatcggcaagagtgtgaactgcagtactgtttggacataataaataacatgtcgcaaacgccgccactgtgcttggtcctcctcggcagctggccaccaggctaacagtccccatatcagcaactgcataccaccaactgggaaaaacacaccaccatcaaacgtaaatagttgaataaaggccgcgccaaataacacgatgagctgtcccatgtaccagcgtcgtaataattgttcggtttccggcgtcataaaaaaatcccccaatctgatatgcattaatcataccagattgggggacgctcacacgtgattttgtttagatttatatggttcagcgacacattgtactagttaatttgtcataaatcctgattaaaacgtgctgattaggtagtttgttgttcgtcagcacgtgcgcgtcctattccgacctccggggctgagtgacaattgctggaacgtaagccgacatcgatttgagcccgtgcacaacccgcccggtctcaaatacgagtcttattctaagccggaagaaaatcacttccgactaagaataatttggctactgagcattgtcacccagcccctccggtcggtaagccgctcgaatggctgatgaacggccacttaacttggtacaattggtcgtcgactattttgataatagaactttaaacgagacgttaggactaccttaaccactttgttgaaacgttcgattattactgtggtgattccgaaatagtgagttatctcaatatcactttcagtctgacagttgattgacaaaattaccgtttatgaaaagcaacgacaaattcatcaaaagttaggtacatcttcgtccgccattcgaatactgtcccgactggaaggcatttcggccaatgctcagcggtgaaattccacttagcaagcgtccttggcttggttagtggaagaccagtatttaagacgtgggttgcggcttaaatctgtgtccaccgcgttccagcaattggcagaaatgcctggaagtcggcgtaggacgcactaactaagcaagtttacgctaactcgaactgtttccagcgggcccaagctggctgcttttgacaataactgtttggcacgcttcaatcatgattcatcccgaacagtaactagcacaacgcgtggttcagcaactaactaataaagatcttgcacccggccctgtgttgcttcatgggccaagtattcatcataagtcgtatcaccacgatcaacaacgcctttcgcactcacttcgacaatgtggtcggcaatcgtttgaataaattcatggtcatgagaagtaaagacgatggcgcctttgaaatcaatcagactatcattcagtgcggtaatggattccaggtccaaatggttggtcggatcatctaataataagacgttagcccgactaagcatcatctttgataacattccccgtactttttcaccaccagatagcacgttcactggtcgttcaacatcgctaccagagaacaacattttacccaggaaacctcgcaaaaaagtattgtcactttcttctttcgatgcaaactggcgtaaccaatcaataattggcaattcactacccgcgtattcttcattaatatctttaggcaaataagtccgcgaagtcgtttgtccccaggtcaccgtgccactatctggtgccatcgacccagcaataatttgcatcagcgttgtcgttgccaaatcgttgcggctaatcaacgccgttttttcattgggacggagcgtgaagctaatgttatcaagaatcttaacgccttcaatcgacttggagacattctcgaccttcacaaggtcattaccgatttcacggtctggcgtgaacttaatgaacggatatttacgtgatgatggtttgatatcatccaacgtaattttctccaattgtttcttccgtgaggtggcttgcttagatttcgaagcattggcactgaatcgcgccacgaattcttgcaactctttaatttggtcagctttcttggcattggcattcgcttgcaacttggccgctaactggctagattccatccaaaaatcataattcccaacaaatagtgtgatcttgccaaagtcgacatcacacatgtgggtacaaacttgatttagaaaatgccggtcatgagaaacgacaatgactgtcttttcgtaaccagccaaaaagtcttccaaccagctaattgattggacgtccaacccgttcgtcggttcatccagtaatagcacgtcggggcttccaaacagcgcttgacctaataagactttcaccttttgcggttcagttaactcgctcatcttcaagtgttgcattgattcatcgataccaaggttttgtaacaactggtccgcttccgactccgcgttccagccatccatttcggcaaattcgccttctaattcagcggcccgaatcccatcttcatcgctaaaatcaggcttggcatacaacgcatctttttcagtcatgatttcatataacttttcgtgaccacgaataacagttgctaacacttcttcatcttcgaaagcaaagtgattttgattcaagctagacatccgctcgttaggccccatcgagaccgtcccagtagtcggttgtaatttaccttccaagatttttaagaacgtcgacttaccagcaccattggcaccaataacgccgtagcagtttcccggcgtgaattttaaattgacatcttcataaagcttacgtgttgaaaactgcatactaacattatttacggtgagcattccattacctcttcttttttaaagtgaaattgtccgatagaaaagaggtcggaattaaacaaaccttccagacctctgtgtcgttaattatatacctttaattttagcatgctttcagctcgtttggcaatcaaaaccatacgtgattttctgaaagcatctcatcattttcataaacaatccaaattaaccccacccgtaaacaccagttttaaccatgtctagtgaacaggcttgcgcgaccaaagccccgcctgacgatcatcacgcacaccaagtaacccaagttagcaaaatactggtctcacaaaagttaactcaaaatatgttgttcaatataatccaatacaccattgtccacattggtacctgtcaccgctgtcgcattggcttggacattttcaggcgcgttttgcattgcaaccgcatgggtcgcatagtgaaacatctcaagatcattggtgccgtcgccaaaaactaacatctcatccggcagaatacccaactgttcaccaagctgtttgagggcgcggcctttgtgcattcccggctgaatcaagtccatactgccctgaccacctgaagcgggtacggcaatgccagcgagcttcggggtaagttcatatactaactggtccgtcattgccgcgggacaaataacgtcgaacttcacaaccggatcagtaactgtggttaaatccgcacatgtctctaattggtaatagtagtcacgcatattagccacaaactgcgggttcgcgtgcgccaacacatggaccgtttgggtgccacacaatgccacttgtaattcaggatacggtgccagggccgctaacacttgctgagtcgcttggggactgaacgtcgcggctttgagtcccgcttctcgttgccacagttctgcgccgttaccaccaatcaaccacatttcagggtaagcactaaaggtcgtggctagttccgccgcttggtgaccactggcaatcacaaactgaataccgcgccgctgtagcgccgcatagtcgttggcaaaccgctcctggtcataatcaccatgatcatttaaaaacgtcccatccatatccgttgctattaatttaatcgtcattactaatcatccatttcatgtaagccttttctaccccttagcctaccgattatgcccgcaaagtacaagtcttttctgatactttgttagaaggcaccaccaccggagccaccgccaaagccaccagaactaccgccggagaagccgcctgaaccacccgacgccgaactagcgcttccagaggcatctaaggcgccactaaaactatcgttgattgcaccggacaaatcgaagtccagcccaccattcgcatagaagagtgggtaatacacgagcatccccgtagccaatgcttccgtaccaaaatcaatcgccaattgcttagtcacttgattggctagtccaaaagccgcggcgtatggcaagatttgttcccacaaaatcaaatcaccgacttgggccgtattaaagtgcccaatatccttaagcatgcggcgtagtccatttatttgattacgtaattccaagcctgcgtcagtattgatggcaatccgccgcctttgaattatccagccgatccagaaagccaccgcggccactaccgctggaatcaccatcagggtcacgaccttcggactaactaataacccagcacccgtggcaatcatccccataacactcacgacaactgctgccatcagccattgattacgaagccgataattagtttcgtcttgatagaccgccacgtcttggtctacttcggtctgccagcggctaaaccatttgcccaaccgaccagctttatcacgcttcccgtattttttgagatccgttaacatgaactgcccgtcaaccgcgattttatcaaaacagtgagccaaaaatgagttagtcactggtttcaattgcgttaaccgcacatccggttttcggtgacccgcaaccgtttcaatcgttatttcttgattagctgctgctcgcaaaatctcagccgttaaagcatccgtattcggcgaccgctgtgcccacaatgactcagcaactgctggtgttactggtggcacgtcaaatgaatgattgatgggaatcggctgctgatgtggcttagccggatgacgagccagccaccaaagatagccaatcatgaccaataaccaaccagccactgcggcaccaaagataacacgacgcagtaactgattacgtcgacgtttttcattagcttcctgtgccaacttagcttcttgtttttggaccgtcgcttttcgcttggcagtattcgtccgcgtattcgtcgccgtgaccgtggttggaaatagtaggtgactttcaacgaattggttcgcgggattatgtcccaacgtcatcgtcacccggcctgccgcgcgctcaacttttgtctgaccacccaacggtccgtgcgtccaggcttgtaacgcgctcacattcttggcaggtaactgaatcacgattttgacattattcagtggtacatcccagccactaccaatcactttccaattcagttcggccgtgtctgcatagttcgttacgacccctttaagccgataccgatagacaacccgtaacttatcatcttcttgaacttgccggtagagcttgacacgcatccggtcagcattttgggtcaactgatacgtgttgttggcccccgtttcacttggcgccgccgtcaccgtggtcccaccattcagttgcgtcgtgaccccttccaactgggccccctgaatacctttcaaatcttgaacattaaataccccgtgataatcatcatcaaattgataagtcatcgcttgcgttacattcgcactaccatcacgttgaatggctacattgacttgatattggtcaatatcataatccgcagccgcgcgcattgctaagctaaaccaccaacaaaatcctgccaatagtccgagcacgctcagccaacttaatcgtcgcttcttcgacatctcaccatcgccccctccaataatcgttagccctagtttatcatactcacccggccgtggggcgcgagatactgccaccgctttcttaggcaaagccgtccttttgttgtagcatagaaagtgacacgaaaggggttttagtcatgccacaaaccacgttaccgactcacattcaagtgcgaggcgcacacgtcaataatttaaaaaatatcgatatcgacattccactcaacgaatttgttgcgattactggtcgcagtgggtccggtaagtcatcactcgcaatgggcgtcctgtacgctgagggggcccgccgctacttaaacgccctgtcaacctttacccgccgccgaatcaatcaggtcggcaaagccagtgttgattcagtacaatacttaccatctgcattagcgctacgccaacgcccccaggttcccggcgtccgttcaaccgtcggcaccatgtctgaaagcttaaatatcttaaggctagccttctcacgactcagctcagcagtttgccccaatggtcaccgcatgctaccaacgcttgatgtggctgaaaatgatggttacgtcacctgtccgacttgtggcgccaaattcagagcgcccggcgccgaagatttcgccttcaattcaggtggggcctgtccgacttgcggtggcctaggccaagttcgccaaattgacccggcactcattattgcggatgaaaatcaaactatcgaagaaggggccgttgcttcttggcacctgcctggacgtaactttatgccgatcgttgcacgcgaaattgggattcccatcgatatcccgtataaaaaccttagtgaagccgataaaacacgcgtattgcatggtcctaagcaaaccgttgccatcaacattccaagcgctaaaggtaaaatctttcacatggacaacgctgtctacgagaacgcctttgccgccgttgaagatagtatggcgacgaccaaaaatgaacgggcaattactcggctgaatcgcttttacaagtttgatacttgtccagattgtcacggatcacgcttcaatcctcagttgtttaactacgaattaaatggtcaaaacattgcgacggttagtgatatgactgtcgccgccttgcatgattttgcggccacgattgtcccgtggctacctactaagatgcatcatcttggacaatcccttgttgatgaattgctactcagcctgcaacccatggaagaacttggactcgactacctcacactcagtcgccccggcgcgaccctgtcaactggtgaattacaacgcattcagctcggacgcactttgcgtagcgccacgactggcgtgttatatgtccttgatgaaccttccgttggacttcatccagctaacgtggcgggcctaatcaaagctttccgcgggctagtcgcccaaggaaattccgtcgtggtggttgaccacgacactagtattatcagtgcagctgatgatgttattgagattggtccgggggctggtaagcacggcggtaccgttgtcggacaaggcactgtcgcagccatcaagcaggacaaagagtccttaattgcgccatttctcaccggtactgccgcgctgcgtgaacgccccgtattaaccgacgatgcgctctggaaaaagggggcccttgctattgaagtggctcatcactttaacatccaagacattacggcgcgcattcccaaaaaccgtttcacgaccgtcacgggtatgagcggcgctggtaaaacgactctggtactagatagtttgattccagcactgattgccacagctaaaaagcgaccactcccaacccacgttaaggcctttgacaatggtcacattcgacacgttgttaccgtcgactcagtgcccgttggtaagaatgtacggtcaacggtcgccacttataccaatattctcgaccatctacgccaattattcgccgccaccccagcagcacaagcaaacggttggaccgctagccaattttcatataacgtcgctgcgggtgcttgcccaacttgtggtggtacgggccaaatctctttagatgtgcaatacctgccagacatcaccgaagtctgcccccaatgccacggcaagcgctacaataaacagacgctgaccgtcaaatggcatggctattcgattgcggatattttagatctcgcggttgacgaggccctaccaattttcaaagcgcaatccgccatcgctaatacactccagattctgcatgatatgggactaggctacttactattaggtgaaagtacgccggcactctcgggtggcgaagctcagcgcctgaagctcacctcccgcattggcaaacgccaaacgggaacgctctttgtcttcgatgagccttcagtcggtttgcacccgctcgacattcagcaactcgtcaaagtctttgaccaactgattcagcaaggggcaaccgtcattgccatcgaacacgatctcgacgtaatcgccaacgctgattacgttatcgatatgggacccgcgggcggtatcaacggtggtaacattgtcgccaccggtaccccattagccgttagtcaaaatccaactagtgtaacagggcaatatttgaagacgcatttggccctattccacgtttaaccaatgaactgatgaccgacctcattcatcacaacggtcttatcgaatatttaatcaaaaagcgtgtctaacccccagctagtcaacttgctaggggttagacacgcttttgttatgctgagatagtgccaatgaagcggacgaaactaacgtccttttccttaatgtaccatttcagttagtcagccgtcccaagatgtctttttgagcactgcatttcactaaatccattcgtaagtcatcacaaagctgatagccacatcctaacgccaaattgaaatatcaataacaaaagattaacaattaatcactgccggtgcgccatcactgcccagatcaacgccagcgcactcacaccaatcatcaccgaacacgccgccgtcgcaccaactaagttatataataaaacgatgccgacgctaccaacgggtgccgccaacgtcacaatcgaactgatggtaccaaagaccgtccctgttaagtgcgtgtcaatttgtggcatcatgatggcgaacatcttcgggtccagtttgccactcatgaagcccactgcaaacatgcccccaagaatcaagattagttgtggaacgactagtaaagtcacataggtcagcatcggcgctagcatcgctgccagtaacaattgaaacaacgagagccgatcaaaccaagtatttttagtaatgccacccaatacgctcccggtaacaaagaccacgttgaccattaaaattgcgaacgaatagctcacgggcatgcgggacgccaagtcaataaacattaagttcaaaatcgcatcaatactcatcgttgcgacgtttaaaatcatcagaatacccagataactgactgcgcccattctagtcgtcgtcagcatcactcgctgaatcacaggccaggcctcaatatgtcgtggtcgtccagcaactttgggagtcgactgaatcgctgaacgtccggccaacaagcagctagcggccccaataaaagtcaacgcattcactattccagctaacgcataatcatgccactgggcgataatcaagacccctagtgtttgacccagtggctcaacaagcgtacttatgctcgcattaagccccatcacttgttggcgatcgtcaggatcaatccggtcttgaataacaattgtcaaaatactgccaccatatcgacctagtagattcgaaataaaattaatcgcaacgaccacgtagaaaacaaccaccgtttgctgagtaatcacttgggccaagacgagatataaccccgcttgaacgaccttagtaccaatcagccagttagtttttcggcgcgtctgatcagcgagtcgccccgttaatcccccgaaaacgtacggcacaactgtcaccaccgaaacgatggcaacaaaccaatgtggatttggaaaattctttgcgtacgtgagtaaaatgatattgaacaaactcacccccagcgtcgtaaaaaaatttgcactagcaatcgtttggagggtccgattttttaataaagtcagcattaacccatctcccattaagataatggacttagcttactcgtcattaccgtggtacaatcagcaagtaggttgcatatatgccacattaaggagtgctagatgacaaacatcggagaaactattcatcagattcgattaagtaagggcttaactcaacaagaagtgtatagcggtattatctcgcgctcattcgcctcacgctttgagagtggtgccaacgatattggcgccagtaaactctttgcaattctggataacttagcaatttcagccgacgagttacgattcatacaccaaaactaccagccatcagcatatgaccaggccctttggacaattcgtcacgcttatgaaacgctaaattttcccgccctagccacttggattcgcgaacatcgacacagcccccacgcctacgaacaactcatcgccagttatgccagcatcttgatgctatcctatgaccatcgttcaatcggcataacaaccacgacccagcccgcttttgatcacctgcgccaagccaagacttggaccctgcaggaactaaaattagtgcccgttctaattccaattattgcatccatcgacggcttggccgcgctaacaccactgacaacccgtatggccgccaattgtgccagttatcaaacgggttggggcgatccctttcacgtcagcaacgacttactcgatttttatggatcactatttcaaactaaattgaactttcatgattttcaatccgctcaaaatctgaaaaccaagttcactgccatcgacagtcaccagttaaactgggatgggcggttgagccaacaattctggcttggcatctggaatctctactttggcgactggcaaattggcaaccaattgcttgatgaagtcagcgtcttagaaacacatcatcacccccggattgataatacgttatttgcaattcgtaacgttcgcactaagcaagcccagacttatcgccaatcgcatcagtctcacaagcatctttaacaccgaaagcctgttctagcctggcaataaattacgccggacaggaacaggctttttcttaatcacacatactgattaactggcctaaggcttactgatagctacgcctttcagattgttataattagcgcgtattgtgttggtttatcatttattatgtattacagcggaatacggaaatgaatttataactcatgatggtctgagcttgagcaacgtaaaaagaacttctccaaattagaagaagttctttttacatgatattaaacaaaccctggcttaaaccgactttgtctggttcaaatgcggtagagccaagaaaatcactaatccaacaacaaataaaatacttaaagaagcagcaccaatcgttgacttccccgtcatttgggtcacgattccaactaggacggggcccatcacggctgagaacttaccgagaatattgtaaaagccgaaaaactcactcccactagtcttaggaatcaaacgaccgaagtacgaacgactgagcgcttgaatcccaccctgactggtcccaactagtatggctaaaatccaaaaatccgtcgtactatttaaccgcaacgcgtacaagcagatacctaaataaataataatgccaagcaagatgcccgtccgggtcgacgttttattcgctaaccacccgtaaagcagtgaaaacggaaacgcgactagctgaacaaccagcaagacaatcatcaacgtggtcgtcgtaattcccatatccatcccaatcgaagttgccattgtaaagatcgtgtcgactccatcaatgtagaagaagtacgccaccaagaaccacgccgcagcgcgataattccgaatgtgtttcaaagtcgaccatacccgttgaaaacttgaacgcaccggatgcgcactgggtgctaatgcgtacttttggtgaacgtttttcaacaaaggaatgtaaaagataatccaccacgcagcggctaagacaaaactccaccgcgcgaccccatagcttgataattgaccaaaaccactggttaattgtaagaccaagaataagataaacgccaagacaccaccgagatagccaaacccataaccatatgacgataatcgatccatctgattgtttggcgccacgtcagtcagaaaactgtcataaaacagattaccaccggaataaccaataattgataaaatataaatacctaatagccacttccaggcactagtcggggcaacactcagccctagcgtcatcaccattccgagtatcgaaaagatgttgagcattcgttttttggcatggggataatctgctagtgcacctaggacgggcgccaaaatcgaaactagtaaggtcccaatactattggcataaccccagtaagccgttgcattggccggtgtcacaccgctaccttgggcaactgccttaaagtaaacgggtagcaccgccgttgtgacaataatgccatagcccgagttggcccaatcgtaaaagatccaaccccactgctgtttattaaatttcattaagttacttcgcgggaacctctgatcgcaatcggaggcggaacgagcattaaccacaatattagtggtgctgatgtccgcccgcttttcctctctctcttttttgtctagtctttgaaaataccatcgaggcaatgtcccggcatggggccatcgaaattcaatccgagtaaccgcgcaaatgtcggcgcttcatcgactaagttagccgtttcaatcatcccaccagctttaactgctggtccattgaataacagggtcgtttgatagtcaggcttagtcgggtcatatccatgaaccccgtggtaacggtctggttgtccgagtgtcgctggatggacgggttcaaccacagttggtcgtcgactttcatcagtaaaataatagccttcctgggcttcaaccatcaatacacaagcggggtcggcaccacgacgtgcagctgcctccccagtaatgatggtctcaacaccttccacctgactaaccagggccttcaattcatctaactggtcaaattccggtcgcgtataaatgtacgttgagccgtccgccgtcttcgccatcacggaccagtcatcttcaaacgtctgatcttgacgtgcggtcaaccagccctgctgagcgaataacgtatttaaatgaatcatgtgatccacattgatttgatagtgatcacctaaaataacaaagttggtatccgcaaacgtgcccgcagctttagtcgcgtcaatcaactgacccacgtgccggtctagccggtgtaaagctgccatagcctcattggatcgcacgccatagcgatggcgcatactatccatgtcgactaagtgaatcatcgttaggttcggcttcttattcgttaacgtatcgactgcacaagccgtgatgaattcatccagttggggctgcttaatcccattccgaaggtgcccatacttatgattcatcgcgagtaagaagagcggtgaactcgccttcaacgagacgagaacttggttcgtccaaatgcggttaggaaagatctcggcaaggttatatgtaatcttgctaccagccgtcactggccataaaaaagccgccgttgttagcttcttttgccgtgccaaatcatatagtgttggtacttgaacatccttttgataccaataccaatctggtgaacggcgtgtcggttgtaacttagtattattaacgattccatgcacactgggatactgtcccgtaataatcgtggtatgtgacggatatgtcagtgttggataaatgcccgtcaccgacttgacccaagtaccaccggtcatcaatccactcagaacgggtaattctgcttgatgttcgcgtaaatcacgaaatcctaacgcatctaaggaaataatgaccaagtgttgatttgttgccatctcaatcgctccttcttacttaataagcttattcgtattattataccgcagaaaattaattggtgtcaggatcgttgacaaaaaacgggcgatcagtgaagcacgactgatcgcccagatttattttcaataattaccagctaacaatccctgttcttgtaaccaccgcaatgctaattgtggccatattgcagcctggtcattcaaatacttgtccttgccaggtttttgcgtcacatgattggctaacgctaacccatgaatcccactaccaaataaatgatacgcagttgcgacctgatgttgtagcatggcctgcacatattttaacgaattgattggcgggaccaactcatccgtcgccgtttgccagacaaaagcgggtttactagctggtgtgactaggcgctgggctgcccacaaccgggcatccgtggtaatctgattacgcgccgccgaagtcgtgggaaaccccgctgtcaaatcaatgactggatagcctaaaataatggcagcatgctgaccttgataatgatccaaatgataccgtgtgcgcaattctggttgggtcgcaacgccattataagtcgcaaccacgtggccgccagccgaaaacccggcaagaataatccgctgacaatcaacatggtgcgcggacgcctgggtcgtaatccaatcaattgttgcacctaattgctgcaacgcccaaggatagacggactgatctcccacaattaattggtaattcaagaccaccgtatgcattccggcggccatcatccgggttgcaattggcgcttcttcccgcccagaatgataagtaaagccacctcccgggcagataatcatgattggataatcaacagctgtttcaaaatcactaatttggtctaaccaatacgccgtgatctgaaatgggtgtgccgcagtatttaatgtacgctgttcaacttgcatatgttccccctcctactcccgtattaccgacttgatttcgctttcattatagtaggtcacatgattgcttgtcaatttttattcgaataaatatcgatatttattcgcttgtttactcgctaatgactattatttgctataattaaattaattatatgatgagcgggggtattaaaatggggaaacaaacattcagcgacatctatcacgttttaaaggaccgcattctcacgggacactacagcgttaagatgcgattacccattgaagacgaattaattacagaatttgatagcagtcgctatgctgttcgtaaggcaatcgcacaactagccaaagacggcctagtttacagcgttaaggggcgcggggtggtcttattggagcacacgccgcaaacccagcaattcaaactggccttaaataatctcaacggtctgcagagcctcaacgcggagcgccacctcgattatcagaccgaggtcgtggcctttcagcaacgaatcgttgaccagccgcttagcacacataccgcttttgaagtgggcattccagtgtatgccattcaacgggttcggatcgtcgacggtattcgggcagtgctggacattaactattttaacgcccagcgcacacccactctgactaagaccactgcccaacactcaatttatcaacacttcaaaaaaaatggtctgaaaattgctgtcgttaaaagaatgctacgagtcgaatccgccaccgaactcgacaaagctcagctagcgctcggtgataataattgcgtcggtaatatgattagcatcgcatttaacgatgaaggacgccaggttgaatacactgaatcccactttattccgaacgagtttaacttcaatgaattaattcgtaattaaaccttaccaacattactcagctgaatggtcatccggaccatccagctttttattatggttacttactttagaccaattcagtcggtcaattaaatttatccgtgaataagtttcaacataaattaaaaatatattcgaataaaagttgactaatgtgctgaattatttataataaatatcataaatgctaatgggggttagcatttataccacgtttcactagtggcgcatttggggtcaagagattaggtcggtcatggagtagagagaattgagcgtcactagaccaatttggtttagtgacttttttatgcaaaaaaactgttgattcgcaagattaaacttgccgaatcaacagttgcttcaaaatacaattttaagcttaataccgacgcttccgccggctaaccgctgcagcacctaatactaatgtacttgctaatgcgattcccgctaaactaatcatctgacttggcgcttcatcagtctgtggtaatgcttgccccttagccactgccaacgcgctagccaccttagttcgtagagcttgtaattgcgctactaacgccgtattatgatgcgctttagcttgtgcgattgcccggtcaatcaagttgatcagtgtttcctcatccttaatctgatcgccaaccactgcttctttttgaacttcctcaaacgccgtttccaattcagtcgcagtttcgtccgtgacccagtcagctgtaatttcattgtcgacttcttcttcgatttgatcgacaacttcgtctggcgtcacaccagcttcgatttcatcttcaatatcgtcttcaaattcttcttctgcgtcttcagcttcttctttgtcctcaatctcgtcaaagtcaggcatttcaacatcgatgcttggatgaactggtttgtcgtactctggttcttcttcttcgccattatctggcatttcgatgtcgatacttggatggaccggcttgtcgtattctggctcctcttcctcgccaccatctggtagttcagcatcaatacctggatggactggtttgtcgtattctggctcctcttcctcaccgccatctggtagttcggcatcaatacctggatggaccggtttctcataatccggaaccggtttgggatcatcttcattatcaacattatcctgtaaatcccaacgatgagtctcagctttcacgttgactttattagcaatgatgttgccatcaatattttgatttgcatcaatttccgccgctggggctaaaatactgccttgaaatggccggtcgacactaatgacaccagttgctaacttgtcactcgcggttgaatcatagaagttccaaagcaaatggttatcaccaaagtcttcagtttctttattatttcgctccgtaccgtcatcataaatgattttgatctgcgagttaacttgatagttggtcgcacctgccgtatcaacattaataatgaccgtattaccatccgcatctgccgatagtcccttgattgtcagcggcgtactcgtgtttaaaacatccgctgacagattgatcacaatgtgtccatccgcatcaggttgcatatccgtcatatcgatgacccgctgattcatatcttcaaaactgtcactcgtataggtggcgttcgcggacgcttcgctaagactagcgctcaatttttccaacttagcaaactctttgtcaaaatcaatatagacgttaccatctttgtcttgataaacttcagaggcaagtaaatggtcgatatagaccccgttgaccatcggccgattaggattcgaaacatcaatctcaatattttcgccaaagataactttattgctccgcgtctcaccagccgaaacaaacgaactcccagcaatattactgatattttgaatatacgaaatatctttatctaataattcttcaataatgttcgtaccaaagttaacgttgcccactaagttttgcaccgcaacgttcccattcgtatgggcatgtagttccgcttcccgtgcaaaaatatggaattgggacgaaaccccgagcatgttatgtagatccggataatcgtccgtcacattaccaccatcggcaacggcatcgtttgcatgggtcacagcttgactaagcgccaccgcgacggtctggggcgttgcagttgtcgtcgactggtctttagttgtcgtcgtttgctgggctacactatcactagtcgtcgtaccggcaatcttagcactagcatcggtagttttagcagccgttgccgcggtatcattgctggtagctgagtcagtagtcgcacctttattagaactggttgttgtccgcgcagccgttgcagtggcagaatcagttgtggtcgacgtctcttttgtcgactctgaaccggttgtcgcattcgtctcttttgccgtctttgaaccagctgtcgtatctgaaccagtttcagtattggcactagttgtctcatccaaattggtggtagcgtttgtatcagtatccgttgccgccttagttccagccactgtgccagcagcagtctttgaattcgaaccatcggtatctaaaaccggctgattttggttagtcacatccgcttcagttgtggccgcagtcttcaaagtttgtgtcttagccgtgactgatttggttgtgcttgaactggttgatgccgtatcagtccccgttgcagtcgttccatcatcagcccgagccaccagcgttgttgtgcccatcgtcaagataacggcacatgcaaacgcccagcgacggccaattttgtacattttaaaattcgtccgttttcgctccatcatttacccacctaaaatatagtttattaactttcctttaattcaattctattttcacgctttttcatacaacattcaactctttatataatttattttgtattgttatataaacagtggatgactgtcaatagacgtgccagcaaccattacaggtcttaactaatcacaagttagtatttttgttatctattcgtttacttggaatatcgattatcatcacgcacttattttacacaatgtctcaaacccacaaacagccgcctaaaattggtcaatacttgcctcgcagtacgaaaaattttggtgtgaaagctcgtttaagcaatcacaacagccgcatatccacacaaaaaaagactggtcacaatcaaccagtcttcaataatttaattagtcacgtattgaccaacgacggtcagtcccgttaacactttacgtccatgtggtgatttggtgtcgatgactgcggttaattcttgccccgcaagattaccatgatgcttaccgccagcccatgctgcaacccccgttacatcataaacgacaccatcaaccgccacgtatgcgggttgaccatcctgaccattatattttgctaattcagtttgattaaatgtcgctgaattcatgccggatcactccttcacaatttaccgtcatgataaactggactgccaagtaaaagcaagtgatccgttcttaaaccaaataattgacctatcttgaacataacacgacatcaaacgatcgccgaagtagttatacccccacaaccatctcggtaataccggcctaacctttgaccgacgaaacttaattaaataggtaaccatacttacgttagcacccaattaatcgtacccgtgatagcagttgtgcttataagtctgccaaaacttaatcgctgaccaattactgctacccacaactacttaatcttaataccttataacatcagcgacgccgtacctcctagtacggcgaccttgtgaaccagtactgttcatgtgtccagtactgcccctaactgcgttattaaaacgcacacctcagccactactgcccattcaatgggctgcgtcgaagcgtgacgtctagacacaccccgtatctaggacgtcgattgcttattgtcaaacaattaattaccttggggtggcccgatcgttgcgacccgatgattaccagccatactggtcgtaatacctgagataacagttcccatcggatcgacttgattacttgctgccagcaaccgttctcgaacacgaacaaccgcatgtctaatcgtcaataccaccgtcgttttaactggttggagccgttgtgtcagtagtgaaatcacttcaaccaacatctgcccagcaactacccagtcacccggtttaacgttgagcttaaatgtaggcgattccaaagcactggttaattgtccaattcgtagccagcccaccagaccattggccgctcgaaagccaattaaccgttgattggctgccacggctgtgataaccccagcaaagggcgcaacaatttgatctgttgccggtataatttgctgcttaaatcctagtaacccatataagtgaaccgtatttgcaagggtcgtcacattgatcacttggcgtttaaccggcgcaactacgggaattaatgagctaatgaccactggcacacttctcacttccttactttataaattggcaaccattcgtatttaaataaccttaacaaacgtaacgtaaaaaacttgttttctttaatatgtaagtcaattagtttaagccattgactgttatctttacaacataaaccataccataattaaactagaatgccagcataattaacggtttcgattaaggtttacatctgttagcgttaattcgtaaactcaattaacgaacgatgctactaaatagctgaaattggccaccataaccccaatgtcgcactcaagcaatcttgtagatttgacatcatgtttccccaatacgtcaatcaggcaatgacggttaggcctacaatttcagtcagaccgattgcgagcaaaaaagagcttccggcttttattccgggagctcaacaagtcaacgtaatttatttttaatctcagccactattcaaccgtaacacgcatccgcccgtgccgctttgaaaaatagaggttctgatcaacacggttgtacaaatcaatcggactaccatcggcttgatgcagtgtcgagacaccaaccgaaatcgacacattgatttcctcgtcttcatacttaacaacgagatgattgactgcttcaaagacctgacggacaatcactcttgtactagccagatcataaccgggaaacaggacattgaattcttcaccaccggtgcgatacagcttgaccttctcgtcattggcggccaagaccgttgtgaccgtggcggcaacttcttgcaaaacgcggtcccctgcaaggtgcccgtacgtgtcattaacgtgcttaaagtgatcaatatcgaacatcatcatcgataagttgagattgttcttggcactatcatcgaataaatatttgatatgttccgtgtaagcggcaaagttctcagtctcagtcaaagcgtcgtgactcgcaaactgggccaaccgtaatttaatctcactatcttgggtcagcatattaacgtaggcgtacaataatcctgcaaaaatcattaagtagccatattcttgtaaagtattgtcccaatccagcgaatatttaagcttgatcaggccccacaagattccgccgtaaaaagcgaacgcgccatagtaatatagccaaggataccgatgcttaggtacccacagccgtagataattcatgctccagaaaaatagcacgaacacgacggcgtaactccacgattcccagtaaaaaatcgactggtcgaaaaccatgtacactatgaccacaggtaacaatgaataatacggcattcgaatattcaaaaaaaaacgagcagaacacgacggcaatcaagtgaaagttaacaaactcccaactatctgctttaccgacgaccgacagttgcatgacaaacacaaagaccaacatataaatcacaccgtgccaagcattgacggtatcatcgtcaatgttaatgtgacgggcatgaaaccacgtcgtaatccaattaaagaggacccagtaaagtgttagaacacctagtataaagaaaatactcgttacgaacggcgaaattcgccaattagaccatgtcatcgtaaggatcctttctcagcatccgccgttgaccaattgccgaccatcatcgactaaccgcggtttcccataatagtaaccctggtgccattcaataccttgttgttcagccatcttttgatcaccctggtcttcgacaccttccagaataaattccagatggtaagactgagcaatatcacgccaaaatgctaattcatgaggaatgcgctccgcttgcccactcatccgtaagttttgcatcgcaaacttgatttgatcaacaaacggtagtgcgtggcgaatattctcaaacgtgttcgagcccgtccccacgtcatcaatgcttaatttaatatcatgttggtggaaaaagagactatatttttgaatctcgtttaatgaaggacattctgtcaactcaatcgtcagcgcggccggattcaaccttttttttaggtaaatgatcgtccctaacatcaggtcgtcctcagcttgttgccggtttaaattaagggctaacacctgattagtcgctttcgtctgcaattgactagcaagttgttctaataattcagcttgcttatctaatgataattcagtgaacgacttcggaacggcccagtgaccattcatctctttacgtaacagtaattcataaccaaaaacagctcgatggctgtgatcaacttggggttgaacaaaaaaacgatacattcatgaagcctcgcttttaatgatttctttatgtcaatataaattgacaactcctgtaaagtataaccgcttttaactaaaatatcgagacatagttacagactttaattaaaaaaattattaagggttatatgtaaccgttatattgaccgtaacaaaaaagaacgtcgtgacgacctcgtcataacgctctttttaccagtcttaatttcacttaaccagcttatcccagatgacgactttaccagctgttagcgacttaggaacgtcgataatacgttgattggaactaccccgaaattgtagcgagagatccatcttatcttgtaaaaagcgcccatctaccaagatatcaattaatgatagcatcttcagtttatcctcagagtcttgttgcaattcttcccaagtataacctgaccacgaccaaatatccttcgtgtttccaaattcggagcgaatgcgttcacaaatccgaatgccgacttgagtatttagaaacggttcaccacctagcaacgtcaacccttgcacataatcttgcccaaggtcttcaataatctgatcttccaattcttgtgaatacggttgtccataatgaaaattttgtgccgccacattataacagcctggacagtggaatgggcagccgctcaagtacaagctacagcggaccccttccccatcaacaaagttaaatgccttataatcagcaacatattgttcacttaagtcctctgccagccattctttgggcatcggattgtttggtcctttcgtagcgcgcggcattcttaatcatctccggagacatatttttagcacgggacgcgatttcaacgtggcgaccatgtaccattggtcgttgttgtgggttacctagatacccacacgtccgcttaacaacatcacagtatttagggtcgtgattgccacattctggacagacgaacccacgggcagtggccttgaactcacccttaaacccacacttaaaacactggtcgatcgacgtattcgttcccaaatagccgacatgatcataggcccagtcccagacggcctccaaggctttaggattctgagtcaaattaggatattcacaataatgaataaagccgcctgacgcatattgtggaaaacgttcctccaaagttaatttatcgaagggcgtcgggtgcttacggacatcataatgaaaactattcgtgtaatattccttatccgtaatatctgcgatccggccaaacttcgcaatatcgtcacgacagaacgtatccgtcaacgattcagccggcgttgaatacagactataatgatagccactttcagccgcccactgcgcacacttatcccgtaacgctttcaccacggtctccgcaaaagctaacgcgtgctcgtcttgttcccagttcggaccaaagaaggtcgtgcagacttcataaattccaatgtatcccagtgaaatagtcgcccgctgatttttgaagagctcatcgacattaccacctgctggtagccgcttaccaaacgccccatacatgtataagagtggtgcattttccggcttagcttccttcgttcgttcgatacggtacgcgagtgcttcatgacaagtcgccatccgttcctcgaagatttcccagaacaactgttggtccccatgtgcggctaacgcgattcgtggcaggttgactgtcaccacgcccaaattcatccggcccgagtttacctcgacaccattttcatcacgccaaccttgtaagaaggaccggcaccccatcggcgtcttaaaactccccgttaattccttgatcttgtcatacattaaaaggtcgggatacatccgcttggtcgaacactcaatcgcgagcattttaatatcataattgggatcattcggacttaaatttaacccccgcttcatcgtgaagatcaatttaggaaaaatcgcagttcggtgctccttaccgagtcccttgattcgaatctggagaatcgccttttgaatttctcgttcaatccaactagttcctagaccaaaattgaccgtggtaaacggcgtctggccctgtgacgaatataacgtattgatttcatactcaagggcttgcatcgcgtcatagatatcttttttagttttggctttcgcataagcttcccgctgatcggcagggacccactttttcgcatcagtcatatgtttttgatagttgattgccgcatagggagccaataattggtcgacccggttagcggaacagccaccatactgtaatgaagccacgttggcaatgatctgcgccatttgcgctgtggccgtttgaatcgaccggggtgaggcaacttcggcgttcccaatcttatacccatttttgaacatgccgtcaaaatcaatcaagcaacagttcgtttcaggcgtgactggtgaataatcgagatcatgccaatggatatcgccacgcagatgcgccttagccacgacatctggtagcatcttcaagcccatggcgcgacttgcagcaccggcttctaagtcgcgttgcgtgttaaaaatcgtactatccttatttgcattttcatgcacaacgctggcatcgcgctcaaacaacttttcaatccgtccttgaacattagttgctgccgcaaaccgctgctgttcagcttcaaagtaatcctgatatgccttagctgccgcggtcaggccttgcgcattcaaaatctgcatcatggtactacgtagctcccgagtatcaatgttgtcagcatcttgatactgggcaacaagggcctgcttgacgacccgtacctcgtcatcagtcgctaacaaccgtcgtaagacaaagtcaattttatacggatgaaatttcgtttgtgcgccaccccgctttgtgacggtcagtggccgtaattggtctaatatatcgttagttgtcgttgttagcatcttaattccccacttttcaaagtcattgattgaatacaattgatagtgcgttctgtttgaatcaatactatatatagtagctcatttccattaacttgcccattgccaaaattaactgtcaccttcagttgtgtacaccaaatcgctttaatcgtccggttagtgcgtctttggaatatttaaaaaatattttttatactgttttttatctaatatcagaatatttaatcaatctcgttaactacctaaccaaccttgatacggcttgctttcaatatttttcacacgccataaaccgaattttaattcgttaaaaattaagctgaacacaaccaagttgttgtaaactgattaacttatgactattttgtttaactcatgcggcggattcgctataatgaaattaagtcctcattgagggatgtggacattggaggagagaataattatgcaaaaaagcaggggaataatcgttggcttgttgttgacagggctactgacaggatgccattctgccactgacacacaaacgcccaccgttcaaccagcaacatcaaaagtcagcgccgttcgctcagtcacgactcgggatttcttaggtcgctgggtcagcgctagaccagcaatgagtctgtacctcagtaccaatcatcaagttgcttggttccgacgcggacatacgcccattcgtagtcgcgcaacgttaacgttaagtgatacacgtgccacgttcacaatcgatcacaatgttgcaaaactgaccctcaacgacgctaatcaaatgaccatgaattatcaagggactaatatcgcactgattaaagatccaaattggcagcctgaacacaaccaggttcccaccacaactaatgacgccttaaaggcgggcaccttaacgccaacatttaaattgtcgtactaattgaaggccacaccacatttgcacgttgacttgtgtgagtgtggtgtgttttttagggcctgacaactagcgaacggcttgcttctgtcaaccgtgctctctataattaaattaatatgactaatcaatggaggaacatcaaatgattcgaccaattgtgcatgatcccgccgcgcttagtgtccctgctgacttagcaacccctgcagacactcaagtcttgactgatttactggataccctcgccgcacacaccgataattgcgttggaatggccgcgaatatgattggggtcaacaaacaaattattgtcgtgcaactcggtccctttgcaattgcaatgatcaatccgaagatcattgatcatcacggcacttacgagactaaggaaggctgcctgtccttacctggtgaacgtccgactagccgctatcaccaaatcacggtgaaatataaagatcaacactttaaaccgcaacaacaacgattcaacgacttcacagcacaaattattcaacacgaattagatcactgtgcagggaaactgatttaattgtgcctacttctaactgagcgggaataaatattcagtttgctgaacttgttgacatttatgaaagataggactggttttatgacaactttagcttataatggcgagacagcaattcctgcactcgctcagcagcgtcgacaccaagctcatcacgcgctcggtaccgacattgatttgaccctttttggtagtgatagtgaccagtacctacaagctgcttgcgatcttatcgaccaatatgaagaccgcttgactgtcaaccggactgtttctgaggtcatggcaatcaaccaggcggcgggccaacaccccgttcaagtgagcgccgccacctatacactcgttcggcaagctgtcgaactcagtcgacaacattttggtttcaatgcgttgattggtccgctcgtgaaactctggcacattggttttactaacgcgcacgtccctgaacagtctgcaattaacgaacgattggccttgatcgaccccgaagccgtcatttgtaatgacgctgatttcagtgtgcttctcaaggtcacgggaatggagctggatctaggcgcaattgccaagggctacattgccgaccgcattcaagattactgggaagcatttggacagcgggccggaatgatcaacctaggtggtaatctgttaatggtggggacgtccccacttcatccggatgggcaatggcgcgttggtatccaagatcccaccactgaccgcggtaacgcgattgccagcgttacgatcggcccctgctcggccgtgaccagcggtatttacgagcggcaccttgaatttaacggccagtcctaccaccacatcttagattcgcaaacgggttatccccgacaaaacgaccttgaaagtgtcaccgttttctcgaaagcttccattgatggtgaaatcgaaacgacgcggctcttctttgcgggccaaccgattcccgattgggcaactcagcgacccgatatttacggcgccatttttgtgactaaacaacgtgagcttcaaatcgttggcttatcacctgaacaagttaccttactcgatgaccggtttacaataatttagaccacaaaataagctaggtcctccaagaaattaacttcttgaaggacctagcttattttatggtccacttataggctagcatttaatttgcagttgactttagatgcggtacgttcgacattaaaaccattttaatcaagcatagctaaatggcaaaaatatagccgttttagttaaaataacgcgacctaatccgctggtagctcagcctctaagcgatcaataatcgcacggacatcatccgttgtcttcgtctgcattaattcattgcgcaattcggccgcatgacgcataccgcgaacataaatcttaaagaagcgttgaagcggtgcgaaatgcccttgtagacctaagccaataaattgatcatacagatctacttgataccgtaacaattctagcatgtcacgcgttgaatgaggctggggaatcggttcaaaagcgtatgggttctgaaaaataccgcggccaatcatgataccatcgactcctggatgggctttggcaagcttcagaccagcctgataatccaggatatccccgttaatttgtaatagcgtcgctggtgccaaagtatcacgcatttgaactaaattatcaattaattcataatgcgctggtaccttgctcatctccatcttcgtgcgcacgtggaccgttaacacgggaacctgctgttgcaacaaaaatggaatccaagtctcgtactcatgcacatcgtcaaagcccaaccgcgtcttaacactaacgggaagctctgcttgacgtgcgccctcaatcacttctttggcacgatcaaaatgtcggattaaatcactaccactatgatttttaataaccgccatatctgggcagcccatattaagatcaatggcttgataaccttgattcttcacttcatgggccgctttcgtaaagtcctcaccactattgccccaaagttgaacgattggtcggggcgactcggcctcatcaacatatagtcgtccccgcgttgtaaacttagccttcgggtgggtaatgcttaacgcattcgtaaattcagtataaaagacatcgggggccgcagcgcgcatcacgacccgacgaaaaacggagccagtcacggcttccatcggtgctaaactaaaaaacggtcgctgggcggcctgagctttggccgcgatccgttgccaatatggcgactgcgtcatagttattcattcccttctagataataatcacttatccataatagcggtgttccacgttgaagcgcaagtattttggcggccgcactgacataattcgtcaatcacaagccaaaataaaagtccggcgttaaccggactcgcaataatagctaagttgataagtttaattgtcgctttaacgaattaaaaccagtgcccacagcaatagtccaataacgagtaccaagtttaacaattccatccgcaaatcagcgaacttcagtgagctgaatgagataccggcagttgtatccatatatcggaagaaaatcccacttaaaactaaaccaactaacaatacaaatagaaccatcattcccgtcatcatcatcacaaactcaactccttatttagtaaaattcttgggctctttgaaaccatgtttatagtagtccagcagctactttcaagcaagtatttccggccgaaaaacaggcgttcttagcatattattattaactaaacgataccaatcattcccagcaaaaaagttctttccggaacaactaaaactccgaaagaacttttttaaatcgccattaatttcgccgtcaacttagtcgctcagactaaattaaccgactggactagtcttgcacttcgaaataatcatttagaaaccgaattgtgcccacacacttgttaattaatcagttgttttatggcgccgttgttgcttactaaaaccaaataagctagttgcggccaataatacgaagcccaatacggtcaaaactcgattggtttgttcaccagtctgtggtaacgtggccgttttagttgcggtcgttggcaccgtctgctgagtcactggcttagccatggccggactcgtcgtcgtccgcaataccgttgtggcttgtcgtggctgcgtcataacaacccgctgcgctgttgggacggaagctgaacttgactgattaagagtgggcttggccgggggcgcttgtgatgccgccgactgattagtactggttgacgtgccagttgaatgactaacgactggtcgttcgcccacaggtttttcagtcattggcttttcggccgctgctgttaaggttgccaaggtccgggcgcgcacggtcgttaatccagcttgagcttgggacaattcccgctgtgcagtaacgacctgatcttgagtacccgcaacgcgctgcaacttagctgtcaccgctgctttcgcctgattaactgctgcttggggctgaacaatatcataatctctttgtgccatttggaagtcgcggctcgtgccactgacctcaattttggcgttggctagttcttcttcggccatcatcacgtgctcattagtcttatcaaggttagcttgtgccgctgttaacgtctcttgcaccgttttcagctttgcctgagtagtttgtaacgtgactttgttggccgcactgttatccttatcgaagttgctctgggctacttgaacagcagcttgtgacttagtcactgccacttgcgccgtcgttaccgcagtttggcttgtctttttagttgccaattgttcatcaagtgctttcgttgccttgacgtgccggtcagtggctgcttgcttaagtacgcccatatgcgtctgaatcttttgattcttggctaacgttttgttggcagcgtctaacgtggtttgcgccgcttgcagatcactcatagccgttttgactgccgtagtagccatggttaatgcttgcaccgcttgtgttacctggtagtgagccgccttaacagctgggttattttcgacctgacttgctaaactgaccgtgccattcatccttactgcctgaccggttcgagtgttagattcggctgcatgtaccgtcattttctgggccatgatgccccctgttaacatggtgattcccatcactatcttaagcgcttttgacatactaaactaatccccttttaaaaagtattgcccagccatgaccagcatgatgatcaatatgaaactgctggaactatttcattttgccggattcaatttcaaaagcaaggaaagctagtgattcagcgtatttgtaatcaccaaccactcaacaactttcatccacatcaccaaaataattatatctagatgtcattactgcctccctcaacacgagtccccatccacaattaaacggtaacgaataattatcaccgctaacaaatgttaacccgcaccatgatttcattagtgacccattctcaataaaaaaaataactaatatttcgattaccgtagcggcctcacaatattgatactaatttataccgttacttaattaggcgggcctcgccatcggtgttagaataaaatttaacctaaagaaaagtgtgactgctatgaccattaatgatctccaagcattcgtgatggtgtacgatttacgccacatttctaacgctgccgtagaactccacttatcacaatcggaattgtccaaacgaatgcgagcccttgagaacgaactgaacattaaactactagatacacacaacaagcgccgtctacaaatcacgccagctggtgaaacgttctatcatcatgcgcataaaatgattacagactatgagaccatgatgcacgatttggcaccgaatcggccaacgacatttgccaagctcatcattggcgccattccaatctcaggtcaatataacattgccaaaaagatcgccacttttgatactcagcatcctgatactgaaatcaaaatcatcgaggatgagggcgaccaaatcgtcaaacggttactgagtggtgagctgcaagcggccatcattcgcgatactcagacgacccaattgcaacccaccgaatttcaaaaacaaccactactcgctgacgaactcaaaattattttaccgcgtgatcaccccctagctgcccagccagtcattcggattcaagacttagcgcggcagaaaattgcaacgttaccaccaggctccggtgtttacgaaccgatcaacgcactctttgctcagcaaggcatgacgccccaattcttctttgaaagtacgcatattgaaacgctcctgggcattctcaatcaaaataacgtgactttcttatttaaacaatcggtacttccgttcatgactgaacacgtggtcatgcgctcactcgccatcccgttcatcagtcaactgaactttgtatatccccagcgaacggggaaccagttactcaccgacttaattgactacttgacggtgactgcccaggaaaatcaacaagtttaaaaaatacccttttcatccgaccaaccggccgtttgaaaagggtattttttaaacttatccgcttatgccaacccaacgaggtggaaccagaacatctcaactaatgcaacgacaaagacaaccgccgtcagtgggattcctaaccgcatcacgtctttttgtgtgtaacccccaccagtatcggggtcgcttccaactaagacagcgaggttgtggaacggtaaaatataatgcaagtttgtcaccgagaagactagtaacgatacagccaagggtgaaattcccatatgagccgtggccgctacgaaggccggaatcgtaatccccatcaccgcaatgacagaacccatgaacatgtggatagtcatggcaaaaacagtaatcacaatcgctaataaataaatattagttggcaagttgcttggaatcaaggtcttcgcaatccaattattcatgccagtcacaccaccgacattcccgattgcgattgccgaagtcaagaacacgagcacgttcacgggaacaccttcccatgatttggccgtcaagatcccgccaactaccgggagactcatcatcagcgcaacaatcaacgtcaaccaaccaacgtccaaaccggtgatcccactcgttaaccagagtgcaatcgcaatgatcagccaaataattgttcgaacttccttccccgtcataccacccaactgggcttgttgttgctttaacgcttccacatcgatgtggacttcctgactaggtttgaagaggaataagaacagaaacatggttaagatggccgcaatgatcatgggcacgcccatgtagataaagtaagagacaaagttgacgctttgaccagaggcctgtactgccaacggatttagtgacgtgtcaccagtataaaagaccccggatagtggacaggacacagcaaagacagcgaggcctagcttagccaaatcgcgtttgggcatcttcgccgtttccgcgaccaccgtaatgacggacataatcatgaacgcccgaggccatggatggggaatcaggagtgcgaggataaaggtcagggaaaaaatcgaaatcacaatccctttccaactccgcacaaacttgataatgaatgcgtacgcgatgcgttgacccaaaccagattcattaaccgctcccgcaatcaagtacgccccaattacgagccacataattgaaccagtccacgccgacgagaagacctgtgacggtgtcgccacgttcataataatgagcaacattaagtaaatcccaccaacgaacgcgggttgcgcgatttgggtggcccaccagacgaccgtcatcaaactaagtgccaagtccatctgccccttagctgacaagccggcaatcggcaagaagtaaataatggcaaatacggcgattccactgaaaaagccaatcgttttcttgttcacgagctacatgctcccttcaattttgacagcaaaaagccccccgaccagcacacttccgttggtctggcggctctttgtaagattaaattttggttcaatgcgataaaaatacgctcatcaagtgcaatggatgacgttacttcaaatacttctcccagtcagccactttcatgaattgggcccgttcaaattggtccttcatatcgaatggtacggtgccatcaatcactagtttagaactcatcccacggaaacgaatcgactttggatcatattgtgggcgttccgatgggtccaacggatgattccgcatgcctgataagaccatcaagtcctgatcggcttggaaacgggtattcatcgtccaaatcacatcattcatatcaaaaatatcaacatcttcatcaaccaggataacagtcttcaattccttaaaggctgagaacgcaagcaaggcagcttgccgttgaattccttcatccgcttcattatccttgtgaatctgcatgatggtcatcaacttacccccaccagccggcggattataaacattcgtcactttaccaggaatggcacggttaaccaattgtaagatactagcttcagttggaatccccgccatgctgacatgttcttcggatggtccaatcacgctttgcatgatggcattcttccgatgagtcaccgccgtcaccttaatcacttgcaaggctggattagcatcaccatcataacccgggaattcaggcatcgctttacccgtatgcgtattgatatcttcctgaatacgttcgttaggcataatgtacccctcaagcgtatattcagaacgcgcaatcgccttttcatcgacggtcaccccgtcaactaattgaacagcttggtttcgaatcgcaccagcaacacctaattcgttatagccgaatggcgtggtcggtggttcgaaagttgcaccaatcgtaatggctggatccaaaccaatattaattgtaattggcattggtttgttagctttctcatactcttccgcaaatgccccgatatgccgaccaccaggcatgatataaatccctaacttatccttatcttcaaggaccatccggtgaatcgtcacatcactcttagacttgtccatgcttgagccaaataccacaccgaccgtaatgtatggtccagcatcttggggcgtattcgttggtgctgccactaacttccgaatatcaaagccttcatccgtcgctttataaacaacatcgtgagctggcgcatccgcttcagcaaccgtttctggcgccactggattagagactgcttcgttcaagtattgccctaacgtctgataatcgtggtggaacatcttaccaacgcgccggcgactcgccatcaatccagtcaagacccgcgtatcaggaacccccttaacgttgttaaacatcattgctggaccctcttgcgttggccgttgaacggtcccaccagcaccgatataccgataaacaccagaaagttccgcatttggatcaacttcaacgtcggtttcatgatagttcttcggatcatctttgatctcatcaagcacgcgacgcaaatcccatggttgttctgccatttcattcatctcccttaaagtttacaagaccatcatacggccactcgtaagcgggttcaattcggattgcgcagatatgttattcgtgaatggaataatacaactaaacgcattaggtcgatgattgttatgtattaattatgattgaaacgtgccaagtttagattgttattcgtcagccggtgcgcgtcctattccgacctccggggctgggtgacaattgctggaacgtagccgacgtcgatttgagctaacgcccaacccgcgtcatctcaaatacgagtcttattctaagccggaagtaccccacttccggcttagaataatttggctactgagcattgtccacccagcccctccggtcgggaagtcgctcgaatggctaatgaacgaccaccgaactcggtacaatttgttgttcgctatttgatactggaactttaaacaaagcgttaggtgtattaagccctctgtcaagagcttaaatcttactacaccaattcaggattagtgagctatctcaatatcattttcaccctgacagttgattgacaaagttattgtttatgaaaaacaatgacgaattcaccaaaagttgggtacgcacatgtccgccattcgaacactgttccgactggaaggcgtttcagccaatgctcagcggtgaaattccacttagcaagcgtccttggcttggttagtggaagaccagtatttaagacgtgggttgcggcttaaatctgtgtccaccgcgttccagcaattggcagaaatgcctggaagtcggcgtaagacgcgccaactaagcaattttacgctaactcgaactttttccagcgggcctaagctggctgcttttgactttggaaatcagcacgtttcaatcataattcatgactaacgaaccggcacagcatttagccgagtcgtatttttaatgcgtgacatgtcgtttattgtgcaaactggggcattactaaataaatacgccgtgtaaacattgataaacagtttaatcatgtttatactttaaaatatgttaataatttttagactttcttaagttattaacgatgattagtcatcaatagccttattcatcgattagcacttattattcatattcaagtgacacgtcttattcagaattttaactcgattgatagtagcggctatttactgtgaagactccagtaaatagttttttattgtcgactaatcaatctatttttggaggagcatcggggaatgtataaacagcaccaattttttaaagccgctgacgatcgtcgcggccaagcatcgttttgtcctaattgtgggcaagcagtggccgcaacggatgaattttgtcctaattgcggttttaagttgcacgcaaccactgatcagccatcgccatcagtaaacaccgcgcagtcaacagcaagttcgacgcgcaaggttcgacaacaagcccaacgccatatgccaacttgggggtggggtctaattgccgttatcgttgtcattctgattggtggctatctgtatggacagaattattatcagccgctcaatcagctcgaccgtgacttaaccgcactcaagactggaaaaggtttagcgaagcaagtaactagcactgacccatcactcaagattacaaatgatagcgtcaagccgatggtcacttactttaaaaacaatcgaaaatcattagcatcactggctagttcgcttaaaagtcgttctgcgactaatgattacggtattcagttcgttaaaaccggtaaagcctggttgtttttcgataagtatcaactacaagtcacttccgtttatgccacactggcgacgaaccaccgtaacgttgcactcagcgttaatggtaagcacgtcgcaacatctaataaagcaacttacgagcataaaatcgggccgtatgttcctggttcatacaccttgactgccaagggaacggttagcagccatcagattaccaataagggcacctattacctccgggcaaacggccaaacttacgacttggatttacgtacaatttccttcaccgttaatggtacaccgaataccaccgtttatatcaatggcgaaaatgaaggaacgattaacagcagtggcacactggcgctgaatgatattccctggtctaatcgcatgatgttggctggtaaatacaaagccggttcacaaacattgaccgccaaacaaactaacgttagtgacgctgagggtcaagacgtggacctcaaatttgccggtgtgatgagtaaagatactgcctcggactacctgaacggtatcttcaccgctgtcagcagttatacgtccaccggtgacctatcggatgcttcggattacgatgaccgcactttggacgactacttcgtcaacggtaccgataacacggactacaaagaactggtccaaatggcgaagggctactacgacaatgatgacgtcctcgatgtcacctatgagccgactgtcttatcaacggttccagcagctaaacaacaaagtcagatcacttatgacgtcaaatatgactttaccaactctgaagatgaacgcattcaggtctttcgttacaccgcgacggtcgagaaaaccggggggcactacaagattgttaaaatcacaccggcccaaaaaattcggtcgtacactaaatccgatgattctgataattaatgaaggagaatttaacttatgaaaaaatgtcccaactgcggcactgagattgctgccaatgcaaagttctgtacccactgtggttacgatctaaccaaagcgacaccggcctcggcaacggccaacgccacttcagccacagctacccaaacaacgactgcaacgacgcaagcagctgtccataccagcacagcttcagccaatcaacaacaatcggccagcgctgaaaaacaaacagcatcacgttcagcagctgctgatacgacacggacggctactaaccaacaagtccaacagctgcaatcatctgctaagaattattttagttggctcttggctagctggaaaaatcctagctgtgaagtccgaactgaaagttattttagttacatttcctttgtcattgaagcactatttatgacgttggccgctgtaaccattagcaataagtttctgaccactgccaatgacagtcaaagctatttccacattagtaaattagctttttccaccgacttaaagattttcttatgtctcctaatcggcatgtgcttctacctggctgtcggctatgtcacttgcttacttggcagtcgtgggaccaaagtcggctttacgacctatatggaacgcttcggtcagttaaccaattacgcaattattgtgaacctattattatggtttgcttcgtccctagttaacttcagtgttgataacttctttaccattgcggctagcttcagatggtcgattatcctgttgagtgtcagtgtccttgtctggcaattaggtttgatcttcgtcattaacaagtcggtgacccaaccattaattagccgtgtctacctagcccttattgcggttctagtcgttagcctgctgttctactttatggataaaattattctgcaggatttacagactgcacttctcagtcacgcaactgactttgccaatcaaattggtaacttgttcggtagtcaatactagttgtttgaaggtatcacaaataaagcctcgtaaattaacgcattatcataagcgttaatttacgaggttttttatattcattagattgagcaaattaatttgtaaccgataacagggtgctactcgaatagtgtccgcttgagctgacggctaacaccgtaacccaccagaataatcgttattaaccatccggccgtcactagtgctttcccgattgcgatgattcggcgcatcgtcccacctccaaaatgagtcgctggttcagccattacgcactcaaccgatgactgaccgatagtaactcactaaccaataagttttcagttggcgtcaagcgcaactgtttagtaaaaatattataagtcacgtcattcgttaaccgcttaattagcgcatgatcaagctggggcgcctgtttcaattgttggtgtgccttcaatagtgctgcccgaatttcttgattcgccgcagttggtgctaattcttgatataaatcttgaatgattccctgtacttcacttttcacgttgcacaccttactttcagaaaactaactactcttagtataggcgtcttccggtaaaagattaaggttattttcattgaacattaaactaatttgtcagcaccgcctttaaactcaccaacgttaactaacctaacattatattaactggcgtaagtcatcatttaaacgcggccagtgctaattggatcgcggtagcgcgcgcatcgccgctaaagcgatggtcaccgtcctgaacccaatgcaactgactgtgctgatagacctcatgatacttttcagaagcctgtggcgagaccaccgtgtcggccgtaccgtgaatcaatgtcaccgaaccggcatactgctgagctacctcataaatcggcaactgttgcgcggtccgcaaataaaagccaccaactttaaggccatcacgaatattcaaataggccggaatatgttgtggatcataggtcgcaccttgtagaacaccttgttgcgcatcggactttaacgttgcggccggcgccatcaagatcagtttgtcgaccacgtctggataatatcctgctaacatgctggctaccaccccgccttgcgaatgccctgccaagacaatgtggtcataatgtaaggtcaacgcttcatctaaaactgctttggcgtccgcgatctcattaaccaccgtcatatcttgaaaccggccttcactacggccatggccattgaagtcaaaacgcagaactgccaagccgtgggcaactaatgcctgcgccaattgcggcacaaattgggtcgtatcatatcccatatcggccgtaaacccatgcatcaagatgactagcgttgtgctcggtgccgctggagtatccaaccttgcctgtaacgccaaaccatcccgtttaatcttaaattccatcgatgtcatctcacttattcattattcacacctttaatatagtggatttacgtgctatttcatagtcctgagcacccaccttatcctgaaaaaaacagctcacaccatacaaaaagcctgtttccacggccttcacatcggtcatagaaacaggtctttaatatcggctggacatcaaacgatttccaactgtaactgctgcgattcgacccactttgccgcaactagaatgcggtacagcacgattgaaataactgctggcatcagcaccccagtcaagagatagaccataaaactgttaaagttcgtcgatgctaacgaaatcggtgcaattaacgaattcaatcctaagccggccagcttgtaactggttgaaaaatgaaaggcaatcgttgctaccggggcggcaataaccgcagcaaccattggtggaatcgctaaccgtggattcaccagcaagtttggaaattggactttaggcgtgataatcccctgcgcgatattggcccccaagttattttggcgaaaagacataatcgtaaagcccacgaactgggcggttgttccaattaaggccgcacccgatgagacgggatctaacatgaccgccaccgccaatgcggccgaagacgcaggtgtcattaaaaataacgcccaggcaagtgaaacggccatcgaaccgatcaacgggttgaccttcattgaagtcgcgatgaacttgctcagccagaccaacgcgggcgtcgttacggctgctaacccgagaccaaccaccgcaccgacaaaagtggccgctaacgggaccaacatcatatcaagcggcgtcttaccagttaaataattaccgatcagaaccgcgactaacccagccgcaacggccgaaatcggttgaccggtggtaaaaatcgagctctgagctgcttgggccaacgtatgccccgtcgctgtgacgccgttagttgcggactgagagaaaaagacagcgttcgccccgatcgtcgacgaaatcatggcgctaaacgtaactaacgtgttgctgttgagcatcgtggcaatcgcgactccaaatgccggtcccaataacacttgcgcaatcgcaccgacttggtataatgccgtccagtgaacaaaattcgcgagtgactgcaataacaatccaatccctaaacaaactaaaatagcattagaaacacctgccgaaactttataaacgtaatccatggtactcatcttatgtgtcgcggtagccgcggtcgtagttgcttccatatgtaggcctccatttaaattaataagaatatgattagataaaaatgagaatagctacatttaaccacgtgttttgaaaattgtcaacgtattttcatcacattatcgttgccaactaaacgaaaagaccagccaggcacgatgccctcgctggtcgctttcactcatcgtattcaaatcattggcacaagccatcaatccaggaaaataaatcgcctaaatcatagtcaccactgtggggaatatcccacggtagcgcaaaatcaatgccataaccatgattttctaacattattgctagaataatcgggattgcaaaactcgtatctcggtcggccgcaccgtggcgaatccgccagtgcttagcaacttgtgacgaagttgtcgttaagtaactgagcggattaatcgcctgaatcagctcagcgtccgctagttgtgcagtcaccgtacttcgcgtctgtgccaaggccgtaaagtgcttggcttgcaccgttgcatcgccaaataaattattctctggactcgtcaaatctaattggtcaaacgccgggacggctttcatgcgagttaacgacttcaaataagctgataaatccaagtccgtcacctgatttccagtaacggcaaagcctgcgtacttatgaatatccgtcccttgatcgaatgccgtctgagcagatgatatcaataattggcgaacaacatcacgaaatgaacccattcccgcctcattaagcgtcaagtgcgtcccgtcactggccgtgagtttcaactggttcaagtaagtactgaactgggcttttaacgccaacgaaagggcctgttcttcaactgtgagctgaccactaaccggttcaaattttggtcgcccattcttggtcgtccccgcaacaggctgataacggtgccagtcattaataccattaaactgccactcgtaggccatgtctgcgtgttccagattatgaatcgggcagtaagctgacaccgcaaagatatcgtcagtcgccggtgctgccccgagcgcagttaaggctggttcaaaataagccgaattgccactcgcacccgctaaagccgaagtggcacccccagcactcgttccattcgtgatgatccggttcgcatcacctggcagccggccctgattataattaacgtaacggatggccgccttcatatctacgataaaagccggcgcttgcccgacccgttgcccagacttatcaaccgtcgtacgaccgcgaattccagcggccaccacaacgtaaccgcgtttaagtgcctgttgaatcgtccctgcattcgtcggccaagtgacacgttgcggatcatccgccggtcctggcaaataaccgccgaccgtattcggcatcagaattggcgccgttgcccgctgataaccattgactgaactgccatgcaagtatgcggctggtacaaaaacgtttaggacctgaatcgctgcgactggatgctgaacgtactgaatattacgggcagcataatattgaatagcctgcccggcaacttggacctgttccggcaccagccagtcagcatcaaaaatcaatcggttactcatcttgtgacctccatttctatctattcgttactttacccccattatccagttaaaatcaaatcgaattgcgcaaccagttatgccaattgcgactaataacgattaacgtagtcagcagccgcttgtgaacccgtcgtaaactaatgttgccgtgcgttaaccagtgagcccttctaacgaccatggtcgccattgctaactaatctaactatttcaagttagctattaaatgaccgctaactaaaaacggctttctgaattaacagaaggccgttttaaaaaataacattatatgtgcatcattttagggctatcagttagccttaaaaccaatgacggataagtgcaccgccacctagcgttaatacacctaacaaaatgccgactgaacgaagcgcttgactgtccatcttagcttcgttagtttgtggcaatttagcaacttggttaggcgttgatggggtcaacgcgtcactttcagataccgttgtcttagcactagactttttagtatccgctgctggcgtttgatcagcaccatcttggcccgtcgttgtgttagcgggcgtactcgtaaagacactcgaagttgaatctttcaatggttttgacgaattagtactgttggaagtcgtactcccatcgtagttactatcgaacccaccatcaacatcgatggtcccagtatcttcatcgatatctggataaaccgccgtattatcttcgggatcttcaatgtcaccagtctgatggccattgtctggttccgtagtcgtattgtcagaactctcagaactagtatttacatcactcgagctttcagaaccggagtggtcggaactggagtccacagcgctcgaactttccgaactagagtggtcggaactggagtccacagcgctcgaactttccgaactagagtggtcggaactggagtccacagcgctcgaactttccgaactagaatggtcggaactggaatccacagcgctcgaactttctgagctagaatggtcggaactggagtccacagcgcttgaactttccgaactagagtggtcggaactggagtccacagcgctcgagctttccgaactagaatggtcggaactggaatcgacgtcgctcgaattatttgagctagaatcgtcggaactggagtccacagcgcttgaactttctgagctagaatggtcggaactggaatcgacgtcgctcgaattatttgagctagaactgttcgaactcgagctggaacttaagtcgccagtaccgctcccaccgttaacgactttttcgtagaccttaccgttagcttcttcgctgttcttgccaccggacgtaccgccgccccattccattacagctttatttttaaaatgataattttgatcaattaattctgtatccgtaattttagtatagtaatcgatgacaactaggttgctgactgtatcgttgaatttcaagtcaaaaccattatcgctgtagttaacttgataagcatcgtcactaagcttatcacgccgcttgtaagtgttggcactcgaccattcaccattgtagacttcaatacctttgatcatttgctgatgatcaccaatggtatcggcaatcgataagtttttcatggtaatttcacgccgatcaacaagtaaggtccacttaatcgtgccattttctttatcaatggtgccttttttagacatattagcttcattagcaaccatattgatcactgatgtatcttgaccgtcttgggtatcaaacacaacgtcttgttcccctaagtcatcataacggtacttcattcccaggttaacatcaatcttaacattagttttaccttcaatcgccgaattcatggtcaagatgacctgaccattgtcgccgacgaccccggtcccaatcacagcgcccgtctcggcatcggtcacatcaaatgtcgcaccaaccgttcgcggcactagattatccggcatatcgatggtaacggtatcccccgctttgaaagccgtatcgccaaaactcatcttatactgaatctgaatcgtgtcggcgtgtttaaaatcaggcccgttgataaccgctgcgctggttgtgtaatccttcgcatgataattagtcgccgcctgcgcagtcactgactgactaaataatagtaagattgcaaaacttactaatccaagtaaccagtatattccccgtttactcaacttcatcaaaaaatcccccttatgacataataaccttcacctgaagagtatacgctagcaagacggattttcaataggatttgtgaataaaacgattaatctgttcatatatcatttagacgtcgtacatacctgtaatggttcacttggggacgaattgattagccctggtcgccataaactgtaggattgtcacgccgacaatcatcattgcaccgataagtccgacccaattaaagtgcacatgtaaaaataatacactcaaaatagttgccgctagtggttcaatggcacctaagacgctggcagtcgttggtaagatatattctaggctctgtaaaaagaacaagtaggccagcatcgtgccaaaaatcacgacgaagccgacttgcccccacgccacccaggttagttgcggcgaatggtgccaagcacctgttccgactaataccaagccaccaccaatcagcattgaccagccaacaatgggtgtggcaccatacacttttaataattttgttggcattaatgtgtagatggttgcaccaaccgcggccaacaatccccagataattgcaattactggcaaagccagcgagtcagtgtgcccctccgtgacgattagaaccgtcccagcgattgctgagaccacagaaatgacgtccactttccctggaagctgccaagtcgtggcggtgataaagataataatcatcaccggtgacaagaattgcaagattgcggccatcgccgcattaccagtactgattgccataaaataagtcaattgaacgccagccatcccgaacaggctgaacacaatcagacgcaccgttgcccgccagtcatgaaacacggccatgaccggtaaccggcgactaaatccatataaaattaacagacctccagatactagcatccgcaccgccactaaccacaacggcgaaatcgttgtggtgtcaaatagatgttgtgccaccgttcccgagcttccccacaaaaaaggcccggcactggctaataacagtcccactgttttcttttgcatttaaccacctccaaaagcactagccttagtctaacaagcaccagttaactttccaatggtcttttcaaattcaacttagacagtccgactgacaaacctgccatcacaccactttaagcaccttatgataaatttcataattgacactgtaatggtggtaagctaatcttatagcggggtatggaggtgccaaatgaaacatcaaaaattaatttattggttggttggaatctttgctgtcgtcttcattggtggcgcattgatcattccaacgccaaccattaagcaacaggttgtcagtattggcaacgccattacggggaatactaaaactaagggcgctacacacgccgtttcggatagtgcccttggtgaaaaatatcaattatccactagtgaaattcacgtcctgcgcaaacttaaagtgacggggatcggtgattcaatcatggtccgcaccacgagtgacttaaaacaaatctttggccattttaacgttgatgccaaggttggtcgccaagtgtcggaagcaccagccgtcattagccaattaaaagctgataatgcaattcagaaaaacgtgctgatcaacttggggacgaacggtccaacgagtgccgccgaaatcgatgggatcattgatcagattggcagcaaccaccagatttactgggtcaacacccgcgttccaggcaaagattggcaagaccctaacaaccaattgattgccgcggccgctaaaaaatataacaatgtgcatctcattgattggctatacgttgcgcaagacaacgacaactggtttgtcaaagataatttacatcccaacagtcttggtgaacgtgaatataccgcaacggtcggtcagacaatggctaaaacagcaacaccatagccactttatttttagacgaggggttctgattacttgcattacccgtacagcagattagcccaactaattatgctaacaacaactttttgggtcctattaaagtgattgattagggtagaagaattgatgaatgccataagtgttgagcgaaactaaacgctgctttagttcagccaaagatagtcctaaatcaccattaaaatagagccggaaaaaggttaaattgttgtggatcaaaaagcttgaacagaccttagcatcgattgcagataaatgatagtttgtttgaatcgtcgctgtaagccccgctaccacggcggcgtggattttccgagacaaaaaactgtagtcatcattcaacaaaatgactcggtgaaaagcttcagattggcgaaaataggtcactaagcgatcaaagattaagccgggttggctaatgtttttcttgaaatcttgcgggtcaatgagtgctagaatcttatcagcaccttcttgaacgaacgtttccgctaaatcgtcaatggaatcgaaatgtaaatagaaagttttgcggttgatattagcgacacttgtgagctccttaacagtaatatcacgatagcgcggatactttaaagcaagcgtccgaaaagccgctttcagcgcagtctgggtgcgctgaacacgtaagtcagtagctggcataatctgatcctccttattaattacatttgatggggtggtcattattaaaccgccgctaaatgtactagtcgttaagccacatgtgggtattattatcataatagcacttattttgatagttaactcgtcctgagtcatgacagattaactcgcgcaacgtgcataatagcatatgcgcctagtaggtaaatggtaatgaggccatgtccgtcgactaaaatgggttaggagattttcgttcagtcaatggtatggtgtaacgcattattagtgagtcaaaaaagctcccagtagtttgcattctgggaggtcaatttgaatcattcttgagtggttagacgtcgtaaatattagaaaaacgataggccgtttggtaggttacaggaatattaggttcgataatgatactgccaaattccttgtggtgaatagcatccggtaatttttgtgcttgcagggaaagaccaagttgagaacgcatcggtttaccgccattgagtcgataacgatcatcacggtaattagtggcactggaaaccacgactgccggagcgttcgttcgcatcgtgactttgcgtccactgatgcgatctagtaattctacttgtggatatggggtgtcgtttaagacgaagccgtgatggagcccgcccttgatgttagcaatctggggcccaacctcgactgggtcacgaaaatcaaatggggtgtcggtgacccatggcaacttaccagttggaataccgtgtttgtttaacgcggcgtactcgtctgcattgattttaagaacatggtggtcaatgaggcgttccgcatccccacttagattgaagtaggtatggttgctggggttgaataaggttgttttatcacttttaccagtgtagctaatagtaaatttaccgtcgttatctaatacgaaattagccgtgatcgtcattgtcccgggatagccgttctcaccgtccaaggtaatatattgcatgacgagtccaacttgatcactagtgtgcagtttacgttctaaaaaccatggttcaaatgaaatttgaggcatattaccaccgtttagatgattttcgcccgcattttgagttaagtcatactgccgccaccgggcatttttgatgatccccgcaacccgagcgatggttgcaccgaaaaaagattgataggtgatgtagtcggcgccgtcgtcaaatcccaagacaatatttgcaaaattaccatctttatcatgggttttgattgcggtgactgtggcgccccagtccataatagtgacgctcatatgatgattgttcactaatgtataataattaatcccgttcccctgatgctcgattattttcataatgccctcactcccatagctgcctgacatgttaccgcctacttttagtatatttcattcttaaagggaatgcgaataataacccagcaagtgttaatgcgagagtgacagggttagttgctagtgaggtcaatttaaataaccagtgtaaataattataattgattgttgataataattaaaattatctaggttgagaagcttgtttcaaatcttggtgattgtgaatggtaccaatctattaaataaggtgaattaattaacttcgtgcaagtaacgacggcaatttagcggcgaacatggctggctgagggtgttagaaaaagattaatgagtaaatagaaataatttatctatttattttgactaactgttgacaacgcttacaatatcgcttattcttagtttgtaaggtatttaattaccttctaatcaattctctttctctcttatgccgaccactatctgcttggatagtggttttttttgagtgaaattagcgaattgatggcggactagatgaagataaggctctcttgtaatttttgaagattgatgtttactcagaaaaaggagtgctcggctgatggtagcattttggggctgactgagttagtttagtgttcatcaagtacaggtgattaggcataccaagcctgatcacctggcaattactggtcagttttgacacgattgccaaccccgcttatactaaaatgtgaagtgagggattgcagttgaaaaaccatgaagtattagacttaattcaagaaataacacgtaatgatgggacctcatacatggagatcggaaacatgttgatgaatggccgcgctgagttagcagctgaacgtggttttattaagcaagtgcggatattacaactaaacattccgcattccacgcatgttgccaagtatgagcaatatattaatgaaacatttacgattcccgatgaaacgatggatcattgggaagaatggacaaaaacacctgacatgcaagctgaggtcgatctgattttgaaagaaaatcatattggctaaaagctgttagccaaagtctagcgcaggagtgtgagtttatcaaacggcggttgtttttttagtaggcgttggctcaaaagttgaactttcagaatgttaattctctaagctcagcttttttgtttggatcatgaaattgactgattgtggtgatttaattgcgggtgcgtagtgggggaaaataacttacaaacgctagtatcagtgttattatcaataagcatgtttaaggaggctcgttattaaatgaagaatggggcattgctacaatttattcaaagtcatttccagacccgttttcgttttcgtaacgcgtttgagacccaattgactgttcagattttaagtcgattaattggcgaacatccggaaagtttgttattgactcggcgagatgttgaagcgttggcaggctgctcattggacgcgccggcactacagcgagaatattttccgcagcgtgcgatgacactgttagaaacggcgttagatgagctggttacgttaagtgttatcatacaccaggatcagggcaggacccgttatcccttatttcggagcgtacagcttgatcaagtgtgtcaacgaattgtgtttaacttgaacctggacgtgttgccacaattaacggactggtcacgggaattacaacaagaacaggagcgattttaagtgacaaagagtgtgattgaaaccttacaggaccatcgaacgcggcgacaatttaccactgaaccaattagtgatgcgcaattcgcgcaaatcatcacaacggcacaacaaatgccgactagccaatatttacaggcatacagtttgattgagatcactcagcctgcactacggcaacaattggccacgattacgacgatgccaacggttggtgaaaacggccgtttattagttgtggttgcggaccaacaccgcaacgtcaagctagcaccgggcgcaacgacgcgtcgggcactgagtgaatttgaccgctttgctggtagtattgaagatgccacgctgattacagcggcgatggtgatggtcgctgaaagcatgggtcttggtagcgttgtacttggatcaattaacaacgacacgcaggcggtgattgacgcactgcacttgccggacttgacgttacccgtctttgggttgcagttagggcacccagcggatgttcctgaaaagaaacctcgattagggttgcccgctgtgttgtttcaagatacctatgctgagcctgcgagttatcaggcggagctggaccggtttgatggcgttttgaatcagtattatcaacatcggagtagtcacgcccgtacggaacacttagcgcacatgacgcaggaagcgacccactcagcggccaaacggcgagagtttttgacaatcgctaggcagcagggctttttgccggaattagaccaataatcgttaccataacactaataattagaatggctgaacgaaaaataaccgttaatgtaacgctcccatgtcactattagctgacatgggagatttttttgtacctaggaggacgaatcttaacattaaaattagattagatattgttatttttactaattataatataattaattctgagacgatgtttactaagcaggcccgagtgaaagctgagtcgatccttattctgatgtgtgatagtaacattgttgcaaggcttgaaaggggcggataatgtgatcaatgccaacttcagaaaactcgtcttagggcgagcagtgggtaacgctggtgacagcatctacatgattgccatgaactggttcattctccaattgaccaacagtgcgttgtggattggtatcatgaatgtggccattgttttaccgggcgtgttgttgtttctgtttggtgacagcatcgaccggcattctaaacgccgattattagttgcggttgaattttcacagctagtgatcgtggttatgctaattggattagttgcgttacatattaagttgccaggtatctatgtcgggctggtattcgtcgcggccctttttggatcactagcttatccgattcaagatacattagtaccgctgctcgttgagccagaccagctagttcaagcacaagcggacatgtcaattgcctacaagggaacggattacgtgttcaacgcgctgtctggatttttgatcagcctctgctcagtgctcggtgttttaatcatggatgcagccacgtttgtcgttaccgttgccacttttaggcggatcaaactcgctgaaccccgtcagcaacacacgcgggaaaattccttgtatctcaaccagcttttggttggtttcaaaattatcagcactgatccgctgctgcgtttattgacgtttgcgagcgtcgtcatgaatttcttctttggcggtttgaatacgtacgtcgttttatttgggcggcatttcggtggctcgatctactacggtattttggagtcgatgtcagccgttggaatattattagggatgacggtagtctaccgacagttaaaaaagttgaccgttcggcagtcttacctcatcggcaactttgggcgcgcgttattcatgatcttgacagtagtgtcctacaaccagttctggctgtttgccatcatttacttactgagctttgtctttcaaggactgacgcaagtatttgagacaccgatggttcaagcgacggtcggttcagaccaactcgggaaggtaatgacctgcttttatacgctggtttccgtgaccttaccgctgggttcgctagcgttttctttcctagctgaccgctttgatttacggctatttttattactatttgccctcttttatgccggcatattcctgctatttctagctagtcacgccttcaaaaaagtagacgaactacaattatcataacccccacgcgatattcattaatctgtcatcaatcatgattaaaacgtgccagtttagattattgttcgtcagccagtgcgcgtcctattccgacctccggggctgggcgtcgattggggtgtgcttgaatagttgggctgctttgacggcggcttgccagccttggtaaaggttcgcacgttggggcgcggccattcggggttgaaagacatcgccggcttggtggatcgatttgagctcgtccaaatcttgccagtatcccacggctaggccggctaagaatgcagcaccgagtgcggtcgtttcgaggtcagcggcccggatgatcttgacatttgagatgtcggcttgaaattgcatcagccagttgttgcgggcggcaccgccgtcgaccatgagtgtgggcatggtgatgttggcgtcgtttttcatcgtatcaatgacgtcgcgggactgataggccagtgattgtagtgtagctttaacgaagtcagcccgggtagtcccacgggttaagccgaagacggcgccacgggtctcggaatcccagtaaggtgcgcccaatccggtgaaggcgggaactacgtaaacttcgttgtgattatgggactgttgggcaagactttcggattctggtgctgattcgatcagttgcatgccatcgcgtaaccattgtagggctgaacccgctacgaagatggagccttcaagtgcataattgatgtggccatcaagcccgtaagcgatggtcgtcaaaaggttgtgatcggataattgcggttgttcgcccaagttcatgacggtaaaggcaccggtaccgtaagtgttcttgaccataccaggttcaaaggccatctgaccgaatagtgcggcctgttggtcaccggccattccactgattggaatttggctgccgtaaagcaggtaatccttagtcgtgccgtaaatttcagagttggaacgcacttctgggagcatcgcggcaggaatatttagtaaatcgaggatcgtttgatcccattgcaaatcgtgaatgttgaataacatggtacgactggcgttggtgtagtcggtgacgtgggtctcgccaccggtcagcttccagacgagccaagtatcaatggtaccgaaaagaagttcgccacgttccgcgcgtttttgggcgccatcaacgtggtctaagatccagcgaatcttcgttgctgaaaagtaggcgtcggtcactaggccggtgtgccggtgaattagctcacccatcccatcagcgatgagttgttcagccaacggtgcggtttgccgggattgccaaacgatggcgttataaatgggtaggccggtttgcttgtcccagacaacggtagtctcgcgttggttagtgatcccgatggcttcgatttgattaggtttaatattagcgtcaattaagacattggcgattgttgaggaaaccgcgttccagatttcggtggcgtcatgttcgacccaacccggttgcggaaagtattgtggaaactccttttgagcgtcggcaactttttgaccggcgtgattaaaaataatggtgcgggtactagtggtcccctcatcaatggccatgatatatttggctgacataacttgttcctccaaagattgtaatcaataacatcatctttgatgctagcatggataattggatttgtgaataaatatcaaaaacttaatatatgaaccagcatctcatgaagtacctgaaatcaactagcacacccataccaatccgataaaatgaggaaagggttaccattcttgctccgataacattgtatttgtacaacggttggtaacggtgctgaactaagattaatgaatatttgaaatgtagaccaatcagcatataatgggggttcaaatcagtgcgaaatggaggattcctagtatgcaaaaacgacgctttttccttaaaggttccgctgccgaggtcgcttggctcaatcagcaggcagtgcgggggtaccagctgacggcgattcacggtctaacttatcagtttacagaagttccacaaggacgtcagctgattgccgagtatatgccacagacgacgttgcaggctatgacgacggtcttccaaccacttgcgagttataggtttcataatgacatggcggtggtctattcagctgtggctcctaaacaacgtgtggtcaataatgatcaacaataccgcttagtcgtgtatcggcatgcccgcgatatggctttgaattggctcaatggctgggtcctggcggtctggctcatgatgagtgcgacgattgtgattagctcgcaattgcaagcaacgccgctattaactcggttgttattagtggggttggcacttggtgcggggttaatggtggctggtattatcaccggtgctcgagcagcgattcgttgtcaccgtgaagtgtgtcgcctgattcgagtcacgggagatgatcacgagacgtggaagccgactttccacgtgttatttaagcatcagcaggccgctcccgatacgacttgctgggaggatatcggcaagtggcagctggcattgcataaccagcgcggcgactattacttcgagttaaaaacaacgttaagtgaattagaaattactaatgcattagcgcaacgcttttcaaagcaggactttgccgtgatgtcctggttaggtttgtacgttgtttgaggggtgtatcctattaattatgtgaatttaatgtgactttttttaagaaagacttgttttctatcataaaagcgtgtataaatacagtcatagacattgcccggtagttcagcggtagaataattgactgttaatcaagaggtcgctggttcgatcccagcccgggcagttggtcatgtttagtgaagtagcggtatctcgtgaggtaccgcttttgtcggcacgaacttaggatactgctggtgtctgatgggtaactgactggtggaactttagaaataattaagcaaaaaaagtcctgacaaaccttgactattcttgactaaaaccgtatacttactatattaaagtaagtggtgcaaagtcacttgctgaaacttaggaggaattcatcgtgacagtaaacttatattattcaacgtccagcaagtctagtcgtagtgcgcgagcatggttagttgagaataacattccattcaatgaacgcgacattattgctaatcctctggatcgcgatgaattgaaacaaatcctccggctcactgaaaatggcttcgaggacattgtttcaacgcgttctaaggctttcaaagcattacacattgatttgtcggacttaggcttcaatcagttattggacctattagttgaaaaaccacaattactcaagcggccaatcatttatgatggtcggcggttacaaatcggttataacgaagaggacattcgggcatttttgccacgttcggtacgtaagtctgaattacgtgaaattcaacaaaaactttatgacgatgatcaacaagcagttggttaatcagatttagcgtttgagacgaaaccgacccttcaagaattgcgatggcattcttgaagggtcggttttttgtcgaaagtgcgatagcagccggacaccagggcgcgtctgagtgcgtgtcatcttaacggcggcgtatcgcggggggcagttgtttcaagcaacggtaagcggctgttatctttgttgagtaagcagattacttggtataatcggttagtttgtgtacaatgtaaaaaagccttacaggaaacggagattttaacataatgagtgaacaagaccaagccgcctgggcgatccaggcgctcgccgctttgaaaacggctgataatcaagttgttgtggagagcatcattaaggtgatcgatgaccaacaagctgaaatcgagagtctacggggttcaatggaagggcaattatggagtcccactagctggcatcaagatcagcaagcgcaacgtgccgcgcgtgatcacaagcccacaactaacaagtaacattgagcagacgccaccaaaagacggttgttagactattattggtctaacaaccgtcttttttggacactgtttttgtgaatttaagttgcgcacgatgccgtgatgcacggagaactagtgcgtatagccagcaactccggggattcaagtatcaagatgcactgacaacgtgtaattgtgatcagtaatctgcgatgctggtcttgtgacgttgagccacaaattggcaggtagctgcgacgagtccaccaagcaggatacccgctgcgttggcaatgacgtcattgatatcgctactgcgattgatcagccaatgttgtgacatgaaatattgcagactttcaatgctagcccccaccaacaagcccgttaatccgaggcctaatagtgagtagtgatgaaagtggcgcttaataccccagcccaatggtatcgttaggatgatattttcgataaatcccagtccgtgaagatatagccgtgataggttcacctgaccgacacctgctggcatgacgtagaccgcggtcccatcgaatgatagaggagtaaacaggatgacactcaggccaaataagtaacctaggctgagtagttgccgcgtccgggcctgtggttggcgaacgtggacaagaatcactaaacaacttagtgttgcgactattaaaataattctgaacggttcccagcgcatgacaccactcctcggttttgattaactgtatcttaccgtaaactcggtggtcagaagtagggaaaccgcgaagcttaacgaagcctttaccggcttaaccaaatcccaagtaaatcagtggttagatgaccgtgattgatgttggtcgtcagccatattcgcaattggtttcgtggtcagcgctaaagcggctacaatcataatgataattagactgaaccagagtgcaatctgggtgccgagggcggtttgcatcgtactcgaagcactcggtgccatgcgggtaccccatgtaatcaagacggccataatggcggtcccaagcgaaccggaatactgttgcagggtgttgaaaagcgcgttgccatcgcccattagttggggcggcaattgttgtaaaccatatgtcagggcattgttaaataagcaactgaacccaatttgaaagctgacaaataggccgatgatcaagccgaccgtcagatgctgagctagtcccgccaagcccaatgttgccagcagcaaaaagccactaccaatttgaaacggtcgctgaatgccacgacggtccatcaatttacccgccaaaggtgacagcaccgctgaacataagctccctgctagtaacattaagcccgacactagtgcattttttcccagtgcgagttgtgcaaagttggggagtaggaaggtcagaccaatctggatgaactgaatgaagaaataaatgagcagcgcccgggtaaagtttccctgtttgaagacggccaggttaatcagtgggtgcgtgcttcggtgtgccaagcggataaagctcaggacggcgagcactgccaacagtagcggtaaccagacaaatactacgcttaagccatgtgtactcaggttattgacgctaaaaatcagtaggatgagtgccgcgacgactagcccgaattggcataaggggaacggccgtgaccgtggtgcctgtgtttggcggatcgttttggccgtaatcagccaagcaatcaaaccaaacggtagggtgatgccgaaaatcaagcgccaggataacaactgtgtcactaagccgccatacgttggtccgagtgaaggggccaatgcgatcaacattccagcggtccccgtaaaacgaccctgagcagtgaaagggacttgggtcatgatttgcgcgaacactaatggtaatgctaagccagttccgatggcttgaatgatccgaccgagtagtaataaccagagttgtggcgcgacggtacataataaaccgccgaggacgaaaccggccccgccaacgttaataatcgtccgccagtggaagcgttgctgaataaacgccgtaatgaccatggtagcggctacggcgagcaaataggcggtcgtaacccactgtaccgttgctagagtggcgtggaattggtgcatcaaggtcggaaaagtaacgttcatcgatgtttcaactaaaatgccgcaaaaagccagactggcggtgccaaaaattgcaaccttcgtttgggttgggatgacaggtgttgttgtagacaaaataaaacctccattgatcaaggccagctcgtttcgtgtgtgaaacgacgcttttcttgatcaatggagatcccattgtaaagatatacaagtatcaaagacgaccttgatgaatttattaatgctttaatcctagcatactactgataaaaatgtcagtccgatttttttattcgctgactttagcgctttgttcggctaaagcagtcaggtgctcgaataggatgccttcacgcagtccattttgagagaaaatcatccggtcagaatctaaaaagcgcatcagactaatggcaggaatcatcccaccaacaataatatcagcccggtcctttgctaatccaggaatagccgcgcgaccagctgcatcctggctaatgacagtattgaatgtgtcatagatggcgttgtcacgtagccgataaccgtgaatatcttcaaagttgaggatattgcatttgcgccggttaattttggctaacgttcggttgctaccacccaaacagacgagtggtaagttgagaccgtttcgcaaccaccagacgctattaaaaattttatcaacgaaagtcatcgttttaaataattgactagcggtaacttggtcgttgaggccgaacttttcggataaactgaccgcgccgattggcagactgattaggtccttggcttggccgtttacgataaggacgagttcgcagctaccgccaccagtatcgaccatgacgcagttagtcgttggaagcgtattgactacccctaagtaatcgtaataggcctcggttgttccaggaatcacttcgatatctaggccaacatcatttttaacgcgtttgagaaatttcttttggttgctggccttgcgtgttgcggcggtcgccacggccttgatagttaagttaggtaagtctttgtagacggcagcaaacgactttagcgctgcaatcgtgcggtcaatggcctcggcttgaagggtcggcgtatccgtggcgttttcattctcggataaacgcaccatttccttgagccggtgagtgaccgcataactaccgtcttcctgaatctgtgtaattgtcattcgacatgaattggaacctaagtcaatgaccgcaaagttttccatcgctaatcatcctctctatcaagatctgaagcatctggctcattcttgggactcatcatcggaatgaactggtgcgcgttgctagtgggcgtagtatcgccgtgatcagccttgactgcttgctcggcttcgcgaatgaattcggcctgggagtccaaaacctctaagccgcgcccatccacacgggcgtacgtattatctggttgcaaaatgcgcgttttgaccgtgtcagcccacattgtttcaaaaattgtcatcgcacggtgactgatttcaggttggagtagtggaaacaataattcgacccggcgatttaggttacgggtcatcatatccgcactggataagtaaatttgtggttcaccgtcgttgctaaagtagtatatacgactgtgctccagaaggcgaccaatgatcgagtggacctcgatgttatccgagatacctttgatgcctgttcgtaaacaacaaattccccgaatgatcagttggatcttaacaccggcgtgagaagcttcgtagagtttgctaataatctgcggatcggataatgagttcatcttcattttgacaactgcgggctgaccagctttggcaatggcaatctcatcgtctagcttttcgttgataaagtcgcggatgccatctggtgagatgtgcaatttgtggaaatacggtggttcagaatagccagataacatgttaaagatgttggaagcatcgattcccatgtctgtatcagcggtgaagagccccatgtccgtgtagaaatgggcagtgacatcgttataattcccagttcccatgtgcatgtagcgcttgataccttcattttctcgccgaacaacgagggccagcttacagtgtgtcttaagcccgatcaggccgtagatcacgtgacaacccatttcttcaagctttttcgcccagtgaacgttattttcttcatcaaaacgggccttaacttcaacgagaacggttacttgtttgccgttttgggcagcctgcccgagatacttgataatcggtgaatcagctgatacgcgatacagtgtcatcttaatggccagcacgtcttcatcttccgctgcttcatggataaagtccacgacgggtttgaaatcatcgtacgggtattgcatcaaaatatcgtgatccttgataagatcgaagatggaccgttcacggtactttgctggatagtaggcgtggtatttcggatagttcaagtcttcgtgaccctgtacggcctttaccagcttggataagaaggtcaagttgagcggaccgttgataacgtatagtgcgctttcgttaattccaagcgctttcgcgagtcgcgtacgttgatgcttactcatactcttttcgacttctaaacgcatgaccttaccacgttcacgcatcttcaattgtttttgaacttcctttaataagtctgaggtatcctcctcagcgacgtctaagtccaaatcccgcatgacgcggtaacagctcgtttctttgaccgtgtagttgataaatagtgaaccaacgaaagccttgataatttcctcaatcagaataaactggttcggtgcgccaggtaaaacgaccacgcgtggaaagacgtccggcacttgtacggtggcaaacttgcggtccttcttatcaccgtttttataaatccgtaaggcgatgttgagcgtgttattcccaatgaacgggaatgggcgtgaagagtcgtctgccatcggtgttaaagccgggtacagctcatcgtcaaagtagttcttaacaaaggcgtgttgttcctcgttgagatgagccatcgacaagagatgaatcgcgtgctgttccagcaatggcaaaagcgagcggtttaatgtattgtattgacgcttgaccatctcgtgggctttatcactgattgcactgacttgatcagcagcggtcagtcccgcgggatccggtttagtgtaattgactgacatcaatttacgtaatgatgcgacccggaccgtgaagaattcgtcaagattactctgtgtgatcccgagaaaacggacacgttctagcaaggggttatccttatcacgtgcttcatcaaggacacgatagttaaaatcaagccagctgagttcacggtttgtataataactttctttataataattcatttaacgtacccccgtagtttaatcactggtgttaaaccaaagacttctttaaagaattccgctttttgtgcgaatacccaattttctaagaagaggtcatcatgagcaaagcaagtaatgatgacccgtggattgcgaatcgaaacggaaatcttatcgattttttgtttgcgaccgtcatccaaagcgtccgcaattctcaagatggcggatagcttggagactagtaagcgttgttcgacttgtaggtgtccaaagtgccgaatgtctttcgacggcgtttgcgcgctatggtaacgcgagatcaaggcgaccatgagcttttcagtatcagtcagccccatcagttcggtggcctgcaagatatagtccgaatgtaagtaatgttggtgtgggtcgatatagctcccaacgtcgtgcacgatggcggcgacttgcaagagtaggcgttcacgtttacctaagtggtgtagcggtttgagctggtcgaacaggtgcaatgagaatttggtgaccaaatcgcggtgcttaggttcaacattataccggtccgcgatgttcttggcggccgtcacgatctgatcattaaagttatattttttatagcccaacttaatggcctcttgaataatcagcccgtccagcacggtcacgttaccgagccagattttttcagcattagtaagttgtagtagctcgttaatgagtagtagttcgggcacgattaggcgtacgtcctcttcatcaacttcgtatttatccatcaagtactggtcagaagcgtttagtacgtcctcgtataaagcttgaaagtcggctttgctgagttcctccacgccagcttttgattgttgttggcgaaagagggtggcaaacggcgcgacgccgagcatgacgacgttactaggctgatctcttcgcccaggcaagaagcgaccaaagtcaacgatttgactcgaaatataatcatccaaaacttcgacatagttaggcacgctcgattgcaaatcttcaagaacttccgcgattcgaactggtcctaaacggaggctacgggagaagacaaagttactctgatcgtagtgcgaaataccgacactaccagagttgattcctaataagtaggtcggcttcgtgatcatttgcttgaatcgtggaaagtgtaccgcaactgcgactgaacgcaggtaggtttcctgactactagataaccagtcgatcttgagcccagtccggacaagtaattggtcttgaatatagtcggcattgttagcggatgacaaggaccacgacccccataaatggtagtccttaacgccataatcgttcatgatctgaacaaaaccactcagtgcctgcgcggcttgttccactgaatcataatcgatcttatgctgatcataaatatcctcaccaagtgaaacgtcggaacgaactcgttctacttggcgtaatgtgcgtaaattgacaatcgacaattcaatactctgaacgttaatcatcataattccaaataattttgctgccatggcgatcccccatttttatgatttcctgacccccaataaggttaaagtcatgtatttaatttaagtttaacacaggttggggttagttaaattagtattttagtagtgaaacagttagcgattacttttagtttttatacgaaagttaagcgtaattaaggccatcattaactttgtatgaatcgtactagttaggtggttgatgtggtgcttaccccggtttcagcggtagcgaacgctaacttaacttggcacgtttgatccaagataccaaaaaggcgtggctcagccgtaacgagtatgcctgaaccacgctagttgatattataagatttcgtgattatcgataattagtttgttcagatgtttttcaactcgtttatcagctggtggcagctgcatgtaatcaccatacatccgggtcaaaatggtgtcatacgcactgggaatcttaacttggatatcttcgaatggaacggtcgttagctcggtcaattcctgataggtcataatttccttttcgtaatcgtattgagacgccagatttttgtaagttcgggagtctgactgctcgtataggcgcatgtattcctcacgttccagcttatagcgattgacttcagctaattgctgaggtgtgtgtttcgtaatcaagttgcgcagtggtgttttgacaaagcggtaattcaatttgagcaggatcgcggcgtccgctaatttatagtgcaacatctgtgaacggcgtagcgcttcgtcatccggaatcttatcaaacggaaagatgtcaacaaacacgcctttgaacgcattattaacgttgttacgttcttcaatgtaagtattcacatccaatagcttcatataactgagtgcataatcaggatcggaggcaccagtctgtaggaagaacttgttgggatcaaggtggcggctggcgacggcaataaagcgctgatagtcacgacggcgcattccaatgtcgatgtcatcgtcccacggaatgaacccgtgatgccgaatggcgccgagtagggaaccaccaatcagaaaatagtcgatattttcagcctcacagattgagatgacggtgcgcatcaagcgcaattcaacttggtgtaagggtgtcaggggcatggtctcgtctcctttttacgtaagcgtttcatctacttttatcatacactttgttgcacaaaattgttagggaggatgcttaacgttgaaatttacgggtgatttcatgcaaaacagttaaaggtgtgttatatttggtcaaaagttaatgaagtgatggtgatcgcgatgaataatgacgaattaagcaaacttctcaatgattattttgaagcatatcaaaatacaaccaaaattatgatggatttagtggcctggccattaagtcaaaataaactatcatttgaacaatttttaatcttgcggcgcatcgccacgactgatgaagtgacgctcaatgatattgccatccagcggcaagtgacgcgaagcgcgatttcacggcaagtcaaatcattattaatgcagcactatgtcttccaggtaccggatccgcgtgatcggcggcggctctacttacatttaacagaacggggacaacaagtcgaacggattgtcgaccaagccattacccagcactttgatcactgggtcaaccagttgggcgcaccacagattgatcaagtgctcaagatgatggggacctttagccagcaggtcacggacctcggtgagccacagtcacaccccgttctacactaggatgtacatgggactaaccactaaattagtattgatgagcaactattttggtcgctagtcaaaaacagacttcttaggaattgtcacaattcttaagaagtctgttttgttacgaatacccattgaataaaaacacttgtactaaagtagggtcgtttcatagaaagtaagcactcaaatgggcgtacttgcttcactgtgatacgtgtagcgctcaatgcttgaagaagttatggtaaaccccttcgcaagcttcaagaaacatcccaatagccattaagtacatggctaacatgttctgcattgtgaagaccaagtagagtaggacggcgtagaggattaaaaagaagattgccgtaattttggaaccagccatttaaatcacacctttgtatggagaatcgtgacgcgttggttgcctgatggtcaagacgagtcgcgatgaccaagagcggttttaaggcaatgaacacgctttatcaatttcattctaccgcagaccaatccaaattaaaaatcgcaattaaacagattcaaaattatttagcgttcggttattgcttttaaataaacaaaatgatacgattaaatacgttaaaagagcaccaaaacacgaacgtttacaattgtgcaattataatttaggcgaatatctggagggaatcatgaataaaattgcggcatattttaatttttcagaattgaaaacgtcaatgcgaaccgaagtgctggctggcttgaccacgtttgtttcgatggcatacatcctatttgttaatccgagcgtcctcggggcttcggggatggataagggcgccgtcttcaccgcgacggccttagcgtcagcgttaggttgtttattgatggggttagtggctaagtacccgattgcaatcgcaccaggattgggcgttaacgcgttctttacttattccgtggttatcgggatggggattaaatggcaaactgctctggctggggtgttcgttgcagccgtgatttttatcttgattacgatttttaagctccgggaaatgattattgatgcgattccgcgggatatgaagttagcaatttcggctggaatcgggttcttcattgcttttattggtcttcatggtggtggcttaattgttgccaataaatcaacggttgttggtttgggctcgttgaccgttgggacgacctggttaactattttcggtttgatcgttacattgattctgatgagtcgcaaagttcccggtgggatttttatcgggatggttttaacctccattttagggctagcaactggcttgattaagatgccatccacaattgtttcggcagcaccttcgttgaaaccaacgtttggtgtggcgcttggtcatattggtgatattaattcgttacaattgattattgttgttttgacgttcttattagtgacattcttcgatacggccggaacgctagttggattggcagaacaggctggattcatgaaaaataataaaatgccgcgggttggtaaagcgttgatggccgattcaacttcgatgttagttgggtcagtgttgggaacctcaccaacttcagcttatgttgaatcttcggccggaattgcggtcggtggtcgctctgggatgagtgcggttgttactggtgcgctattcattcttggattatttttctcaccgttattaaacgtcgtgacggatcaagttactgcacctgcactgattattgtgggtgtgttgatggcagaatctttaaaacagatcagttgggaacggtttgaaattgccgtacccgcatttctaactgttatcgggatgccgttgacttatagtatttctgatgggattgctttaggcttcattgcatacgtcattacgatggtcgcaactaagcatgccaaggaagttcatccattaatgtacgtgctgttcttcatcttcattatcttcttgtggatattaaatgtctgacagttaaaggtggtcagctcgacgttattggctagttacagataatttaaatgacttaattctaaacggactactgacgcacatgatgttggtagtcttttttttgacgcgaaataggctaaaacttgatgagcgtcaagttggtttgctttggaggtgactatactggagtcattcaagtgatagaaggggaaggtgaaataatcagaaagttaggataaatattgaaatgtaagcgtcgtcatcaaaaactatcttgaaactagctcgtgagcagtcaatcggccgagatttgctaagcggggcaagcgtaacgagtggggatgtacccgtaccaattcgatttaataagacaaatacacaattagtacggtggttaaggtggtataccggtgtcaaaaataatgcaaaatataaaaatacaaaaaaatacgttttttttaaaaaaattaaaaaacgctccaaagcccgtcgttaacgcttgtaaaccatagaaagtttcgtgaaattttcaatgatagataaagtctattaataaaagcgtttacattttaaaaattcgtgattacaataaagtcgtaaagttgataattaaaatatatcagaggaggacattactaatggctaaaattagtggttcagatgccgtattaaaagtaattcagaagtggggcgtaaaacatatttatggtttgcccggtgggtcgttcgattcaacgatgaacgccatctataatcaacgggaaacgttgaagtacatccaagtacgtcacgaagaagttggtgcgattgccgcttccgctgattataagctgactggaaagatcggcgtctgctttggttccgctggccctggtgctgtccacttactgaacggattgtacgatgctaaggaagatggtattccaatgttagcaatcgttgcacaagttcctactaagcggatgaacatggacttcttccaagcaatgaatgaagaaccaatctttgacgatgtggctgtttggaatcggaccgccatgaccgctgaaagtttaccaatgatgactgatgaagcgattcgtcaagcctatgcacacaatggtgtagctgtcttaacgatccctaaggactttggttgggctgaaattgaagacaactttgaaacgaacgctagcgtgcacactgttaactatcctgcaccaaccgctgaatcagttgctgatgcggttaaattaatcaaagctgctaagtcaccaatgatttactttggcgttggcgctaaggacgcggctgaagaattaaaagctgcttctgaaaagtttaggatgccacttgtctcttcagtattagcgaaggggatcattgaagacgactatcccgcttacttaggttccacgggacgggtcgcacctaaaccgggtgccgaaattggttttagtacggatctgattctctgggtcggtaacaacgtgccattcagtatcttcttatttaataagaaggctaaggtcattcaaatcgatattgatagtgaaaaatttggtaagcgccaccatacgaacgttgccattcaggcggatgctaagaaagccttagcagcaatcaatgcggctggtgaagcacgtgatgattcagccttttatgacgctgcagttgccgataagaagaactgggacaattggcaagccagctttaacgatagtactgaatcgccagttcgtcctgaaccaatcttcgatgtgttaaaccaagaggctagcgacaaagctgtttgggccattgatgtcggcaatgtcaacattaacttcgaacggttgatccggatgcacggtgaccagaaatgggcaacttccgggatttatgcaacgatgggcttcggggttcccgctgcgctcgctgctaaagtcaactatccagaccgggacgtttacagtttgagtggtgacggtgccttcgcaatgttgtcagaagaaatcttggcacaagttaagtataacttgcacgtcatcaatatcgtcttcagtaacgaaaccttaggctttattgaagccgaacagactgatgacagtcatcaaccactctctggtgttgatttaccagatactgattgggccaaggttggcgaaggctatggtgccgttggctttaccgttcggaccaaggctggattcaagcaagctcttgaagacgccaagaagacggataagccagttgtcattgatgtgaaattaacgcatgcaatgccatttacaacggaacatatgtatcttgatgacgcatggcaagataaagataagattgctgaattcgtcaagaagtacgatgctcaagatttgaagccattcagttatttcttaaaacaagcccaagctaattaatttgggtagctaattaacgaaagaggacgcgcttgtcgcgactcttttggtacataggattaagtgtcaccggccactgcggcggtgatgggatgttcaaactgtaaatcacgctacgtaaacgttcgggaggtcgcacagatgcaagtaatcaacttagatgcccagcgattaaagatgctggcaccacaaccgccactggtattagctttaggtttctttgatggtgtgcatcagggccatcaacgcgttattcaaacggccaaacgaattgcgaagcagcgcggtttgccactcgcagtgatgaccttcaatcggcacgcgtcacaactatttcagtcccaagccacctttcgttatctgaataccgttgcgcaaaaaatccagcacatggacgcactccaggtggaccgactatatattacggactttaaccaccaatttgctggattgacaccgaccgcgtttattaaagattaccttgtcgggctgaatgcgcaagttgtcgttgcaggatttgactatacgtttggacagggtggtgtcaacgggatgcgcgaactcgcggaactgggtgcaccgtactttgaaacggtcacggtggatcggttggccaatcagcaacttaaagtcagttccactcggatccgggatctgattgctcggggccagttggaacaagctaacgagttattaggatacacttacgcgacgcaggcagcattcagcccgttgacgcgcaccattcagcttgcgaatcgacaacagcagttaccagcggccggagactatcgttgctggttggtgggtgctaattatcgccaggcagtcgttctccgggtcaccacgaccttgaaaatcatttcgccataccaattaccgccagtagcggcagtactagatgtagacattcagtggcagcagcgggttgcacaggcggtcagccccgtcttagatcagcagcaacaatcacaatgtcgtaaagcataatgtggatcaccctatctattagatggggtggtctttttggctgccattaggtcaaaccgttgcgcgtccaatgtcagcgaagccggtcgtgcgatttgggcaaacacagcactgggtgcatggccgattgcgtttttctggtcaagagcaagtcttgtatgaaataatcgaatgaatagccaactggggataaagttgaaccagtttttttgtcctgctatttgcgcttacaaaaagtaagcatattaattgcatttggacttgaaagcgatttataatgcatttgttaaatgaattggaccaaatagctcacttggttctaagtcgaagggatggatagcgatgacaaagatgattgcaggacaagctttagttaaagtgttagaggcatggggtgtggaccacatctatgggattcccggtggctcgattaatcatactgttgaaggcttgtaccttgaaaaggccgatattgattatattcaagttcggcatgaagaggtcggggccttagccgcctcggcagatgccaagtttacgggcaaaatcggcgtttcatttggttctgcgggccctggcgcaacgcacttattcaacgggttgtatgatgccaagatggatcacgttcctgtattggcacttgtcgggcaggtcccacaagcgacgatgaacacgaattacttccaagaaatggatgaaaccccaatgtttagtgacgtggcggtgtataaccgtactgtcacgacggccggacaattaccatatgtcatcaatcaagcgattcgtgaagcataccggcagaaagggccagcagttgtcatcattcctgaaaatctctcggcagaagaaatcgactatcagccggtctcgacgcctaacaccgtctcagatacgtttgaacaacgggtcgacccacaagcgattacggcaacgctgaagatgttaaaagcagctaagcatccattagtttacgctggtcggggtctgcttggtgctaaggccgacctggtcaagtttagtgaacaattcaatatcccagtcatgaatacggtcccagcgacgggggttattccaaccaaccacccgaatgcaattggcacgtttggtcgcttgggttctaaatcgggctttgaagcgctccaacacgctgatttgattttgttcctgggatctgaatttccatttgctggcttttggccgaaaggtattaagatcattcaggtcaacaataacagttttgatatcggcaagatggtcccaatcgattacgccgtcatcagtgacgctcaagcttatttgcaagcaatgattgcaactggcgaaacgttgcctgaaacggcgtggttgacgactaaccggcagaataagcgtaattgggataagtggctccaccaattggctgctgatgaccatgatggactcgcaccggaagcggtcatgcacaaagttgctagtatggttggccctcgtgatacgtacggagtcgacaccggtaacgtctccgaatgggctgttcgggggttaccaatggatcaggaccaacgctttgccttatcgggcctcttcgcaaccatgggctttggcctacccgctgggatggctggtgctttgagtgttccagacagtcaagcgtggagtttctccggcgatggtggttttgcgatggttgcgccagatattattacggaagcacgttacggcttgcccgtcattaacgtgatcttcagtaatcaacggtttggctttatctatcgcgagcaggttgataccaagcaacacttgtatggtgttgatttaacggatgctgactgggctaaagtagcggacggcctcggtggcatcgggtttaccgtccacaataacgaagaggtcgaaaccgtctttgaccaaatcaaggcgctccaagcgaagggcaacaagcggccaatcgtggtgaacgcggtcatcaagaatgatgatccaattggcacggcttacatgccactagatcctgaattatacggtcaagtagaagttgacgcttatgccaaagccaaccacattgatattaaggaacagccatcactaggcgccttactacgagcacagggtgatcagttatagttatggcataaggccgattgagttcactgggccaagcctcagttaacctaatattatgaaaaaaccgccagtatcgggtatgacctgatactggcggctttttgggtgttcagttaggatttatttttgattaaagctaccatcttccacgtcacgaatgaactgtttcaaatggtcaaagtagacgggggcgttgtcgatcatgtggtgatgcccaccattgggcgtcgttactaggcgtgagttaggaatatcacgggccatgcgacgagccgaagctaatggcatcgtttcgtgttcaccgaaagttaacagcgtcggcactttaatgttgtgaatctgatcgcgaatatcccattcctttaacttaccagtgatgacgaattcattatcaccttgaaaggcgttgtacactggagtagcggttgtgttgatcaaatgccgaattgaagtgggctgcttgcggtcaacatagccagcgttcagaacatccacgtacttctggtattgaggatcattccagttgccttctgcttccttttgcttcatataagcaaccgcgtcagccggtaacgcttcttcacgacacttattaacgttgacgacgtattcttcaatgttatcgaccatgcttgaaatgatggcgcctttcaagtgttgaccgtacttgagcgcgtacatcattgtcagagcgccaccccaagactgaccaatcagataaaagttatccagtcctagcttttgccggacttcttcgacttcatctaagaagtagtcgtaggtgagatatttcttagcgatttcgggatctgagtagtcgggttgatccgagtaccaggaccctaattggtcgtacattgaaacttggacgcccaaatctgctagttcttcaccgaagttttcccagtattcatgattgccaccgggaccaccgtgtaggcataataattgaatgtcgccctggccctgagtgttcgtccataaatggtagccattatccagcgtgatgattgtcgttccttgtttcaaatgatcacctaatttcttcatattttaattgttatcttaccactgttaactaagcagggtcaaagggacggtagtcgtgattaactaagggggactcctgcgcagtaacggataaatttgtaagacagtcgttgttaatgaactaactcaatgtgttagcatggtaatagttgattgtaagactacaaattttggttgtggtgatataaaaataataattagaacgaaccgttgccttttaatttggtttatactagttattatgctggtcaggacaacggttaaactgagttgttgctggattacaaccgattgtacacaattgatttgacaagcggttacattttcagcgataataagtaaactgctcagcacagaaagatgtaatattacattctttaaattcaattgcggttagttaaccaatatgaaataatgggttaactaattagagataggtgagatggatatggcaaatcaagtcgcagttttgcgcttgctaatccaagcggcacccgcgtattgttcgggtgactggttggcacaacaacttgcaatcagtcgaacggcaatatggaaattagtgcaaggattgcaggcggcgggccataccattgagagccggcatggacggggttaccgttatgtggctaacaatcaattgagcgcgtcggtgattgaatacgggcttgcagcggcgcccccgtttgagctgaccgttttacccacggttgattcaactaatgcttatttacgacgattagtcacgcagacaccactggcaattccccaagtcgtggttgcggatacgcaaactgctggctacggccgatctgggcggactttttattcgccagcgcagaccggaatttacatgagtatcggggtaccaatcagtgatcagcgggcgttagatgcggggttgttgacgacgagtaccgcggtggtggttgctcagacgctacaacagctgtttgcggtagacgtttcgttaaagtgggtcaatgacgtgttagtcaatcagcataaagtggttggcatcttatcagaaggcatcactagcctcgaaacggggcaaatatcagcagtcattattgggattggtatcaatctgacaacgacggcttttccggcgctgctggcgcacaaagcgggtgcggtggttaccaatccgaatggtgtgacgcgcaatcaagtgatttgtgagttgttacggcggtttttcacgagttatgggacttatcgtagtggcgcgttcatggctgcgtatcgtgaactctcaatggtgatcgatcagcaggtcgagttgaagagcgggacgcagaagtatcgcggtgtcgtgacggatattgacgcgcacggtgcgttggtcgtccgattagcgactggacaagtccgccatttcagttccggcgagattaccaaagtgaatctcttgtctggtggttatcatggttagccggtttgtaaaatcagcttattaagtcaccaaacgaatggcaacaatctttcaaaatgatttctgattcaatgttttactggttcatactgttgtatagtagaagttagtcacaagtcgggccaatcaatttcagtttagttaattgggcggtttgggatggcgcatcaaccttaaattgttgataatataggaatgataatgaatgaattaatagactcacgtttgatttatttatattgtgattaagttcggggttatatatgtttaaccagcatgatgaataaagtggttaataaaaataattaatgaagtttaaataatactggtcaacgcggtcatttacatattatagtaaaggtaccgagacactagtgggttagttaatgtttgtagagacaattcaaggggtaataggaatatgaatgaaaatttgcggagcgtaaatatgagccgaacaatgagtcggatgaatcgacaccggatgaatccaaggcgctatatcaccggatttgacggtatccggacattggcggtgctgggtgtcatcatctatcacttgatgccagcctcgctacaaggaggttatttaggagtaccgatttttttcgttgtttcaggttatttgatcacagatattttactacaagatattttaagccggggacacgtccggatatggcggttcctcggacaccggatgcggcggctgtatcccgcattcgtgacgatgctgttgggaactacaacttacattacgctgtttcaacgctcgctactgacaaatattcgcgccactgtcttaacgaacttagtctacgtctataattggtttgaaatcaatcatgggcaaagctattttgatcgtttcaatggggaatcgccgttcacccatttgtggtcactttcaattgaagggcaatattacttattctggccattagtgattggtatcttgatggtcatcttcaagaagcgttcacgggtcttctggtttatgatgattgccgcgggtatctcagcgataactatggccatgttgtatgatccagcaaataccaatcgggtttactacgggactgacacgcggatgttcgcaatcctgttaggctctgggctggcttttatctggccatcacgcgagttatcggcggatattgccaacgttaatcgggtgaccctggacgtcttgggtggtgcttcgttaattgctattatttggatgtttttccagatgtctggtcaatctgatttcacttatcgtggcggtatgttactattcacagtcctatcaaccgtgttagttgcaacggtcgctcatccggctagtcacctcaatcgcgtcttgacgaacccgttattcaagtacgttggtcaacgtagttatgggatctatctctaccagttcccagtcatgattttttacgaaactaaagttaagaacattggtgatcatttactcctaaatagcttgattgaagtcgccctgattctgattgtgacggaattgagttatcggtttatcgaaaatccaatgcgccactatgactacagtcggttattggtcgatttcaaggactttctccgtaaaccgaagtttaaccgcgtgaccactgcaatcgttgctttgaccacggtcctattcgtcattacggcggttggcttcgtccaacaaccaagtaaggcggaggccaacaagaagactgagctgcaaaagacgattgcggctaactctaaagcggctgataagaagaatgcggcggcgctcaaacgccaaaaagctgcccaggcagcggctgcttcaagcaagaaggtcgcgactgaaaagatgcagactaagcaggctgaagcgaagttgaactcgaagcaaaagcaggtggaaaaggaatacgatttgaaaccccaagttgttctagcgatggctgatacggacctgaccgctattggggattcagtactacttgatgtctcctctgatctgcaagatgttattccgggtacggtggtacaaggtcgcgttggtcggcaagtgacggaagttcccggtattattaattcactgaagtcacagggccaattggcacacaacgttctcttgaatattgggactaacgggacgattacgaacgatcaagctgaacaagttgttaagttgattggtaaggaccgtcagattttctgggtaacggcccacgtgccaacgcagagctggcaaaaccaagtcaacgcgcaaattgcaaaaactgctaagaaacatgcgaacgtgcacgttatcgattggcatggtcgtgcgcagaatcaaaatggttggtttgcggatgataatgtccatcccaatccgactggtaatcgtcagttaacgaatttgattgcgaaccgcattgccgaagttaataacaattaaagatgagttccagcttacgttgatggtaagctggaactttttttggctagttccggacgggtgggggtgtccgacctggtcatgataagtggatatttaagttgaaggtacacaaaaggcccaccagttaacggttgtgtggttagctggtaggccataattagttagtcggttatttttttcattgggacgtgtaagcgaatatcgttcaagttaagtgagtactggaggtcttgattgccgcgaatcgtcatcttcatatcagttgcgtaaatgactagtccgagttgatgccccttcagtaagtggtggaacagcggttggagatccacagaaaagtcataaaagacatttggctgaatcgcttctgcgtgccatgggtggtgacggttctgcaagttaagatgccccttagtaatcatcttgaacggcgtctcacccgctaacttgaagtccttcaaatcatcttcgcgccagtggtaacctagatcaagcgcttttgcagccagcatttgtgggctgacagtcaaacggcgcgcggccccgaagtcaatcagcataaagctcaacatgccgaaattcttattaacggcgacagagcccgcaacgtgcggaatacccactaataattgatcctcaggcgcctgccaagacttgaacaagaggcggtgatcatagagcggatttaacttatcctcttgcaagaggtcgcgctgccaactatccaaatgatgcttatagtggtcgaataatttgtcaggcaatttatcagtaaaatgagcggcgcgttggtcaactgtatggtcagcaggaactaattctttgtactgaaccttaaaatctaaagcgtcggttgtgtcttgccaccaattgtcatagccgtgccaagtttgggcttgcgtgttgtcttgtaccaagacgttaggcaagagtgtctccgcatgattatctaaaccatataatttatggcttagccacaagttcatcatgtcggtgaaatcgagcgattgtaagttattgatataaatatgttgtccctggtgcaaaatgagctttttagtaacgggaactgcctgtaatttatcccataaattagctacgttgcggggcttaacgttccagtcattgagcccgtgaaccatgatgatgtccgccttgatcttatcgacattcttgagatagttgcgttcatcccagaaacggttatagttgccgcttgcccggtcttggtcggcggtcagttccgccagtttctgatcaaacgcgggttgaatctggtgggcgtcaccggcctttagacttcgtgaaaagacttcggcggccagcacatcggtgtcttctccttggaacgtatccggagcgacgactaagccattatctcgataatagtcataccaacttgaaatggccgcttcggaaataatcgtcttaaggccagccacgcctgtcgtagcagcggcagttgcgagggtaccgaggtaagaccggcccgtcatagcgacggcaccgttgcaccaccaagctttgattgcgacatcgccatcacgattggtgaaagcttgccgtttaccggtcaaccattcaataattgcgaccgtggacgtcgtttcatcaacgtcaccagtgggggccagtccgtccgagtcaatcgaaccgattccagccgcatagacgactgcaaaaccacgtgccaggaagtaatcattaagtgtataagatttttcccgactgaaagtctcttccgcctcatcggtcgtcgcggtcgcagttcgagcagctggcagttgcgctgttgttggctggtattcaacatccgcataggtattttcgtccggttctttggcggtcagggggacgtccacgttgtgcatctgggcgtcgccagcccgatcattgatgccctggttataaggactagcagtatagagaacgggtacctttaagccggtctcggtctcggctggccgaagaatttcaactttgagcaggtcccgttggccatcgtgatcagtatccaaaggcgcttcaacgtagaccacgtcgcgaatgagcgcgttggtatcaaagacggcttgggccttaccattgaagaagagcggcttttgatcgttgggtaattggtaaaatggcacaaagtaaccccgcgttgtgagtgactcaatcaaggtctgaccattattcccacgtgtattcaatagtaagtaccaagcatagtagagggcttcacgatcaaaggcgctatcaccgaccattggcaagtgaatgtcacgcatggctagcagtgggtcggccagatcaaaatcttgaccgggtagaaaaccgagtaactggagaccgacgttatagaagacttgattgttcacgatagtcgcgtcggccaaccattctgacagggtgagctgactggttgccatgatgttattaaacttgtgggttaggccacttgttgtgtgcacctctggtaagcttttagcaagcagtgcccggtaaacggctgggacagtcgtcagggcgtccatgtcaggcgtaataaaatgaattgttgtaagttcggcaatcgcagtttccgaatcggtcgggacgattgcaaattgattatttttcataagtaaattcctcattaagtattattagaaatattataccgctaattacgtcagaaccaacgattcttactgacaagtttgtaatgttgtggtaggttaattgcaaagtgaactatcgaatggaggaactaagaatgagtgattttccaatcttatatacgacgcaagcgattaatgaagatggtatccaagggcacgcttacgtgccggatgggcttgaagtgccggtttccagtccacttaagtcggtgccgggatcgaatccggaacagttgatcgggttagcgctcagtacgtgcctcaacgccacgttggaggcaatcgaaaaggagcacgggcaagcacatcagagtaaagtcgtgaccacggtcaagatgtcgcgagaccgtttcggctatcagttcttcttggatgcccgggtaacgattccagaagtggatgatgaaacagcggcccactggcttgcaattgcggagacccgctgtcctgttgccaagctcgttgggccgtcagccgacgtgacgattcaattagcctaatcgttgtgcggtgtaaaagtaatcattaatcggcacttggcaaccggttgggggatggatgtaaaacgtggttcgaatcggcaatttcagtcgttgccgactcgaaccacgtttgtgttaatgaggcgtgtgaatgtgcttgaagaggtggtgtaagttcgggtgctggcagtgatgactggcaaccgctgactggactttatcgacctgttgtagggcgagttgcttcgttttttcacgttcgattttgagctgcttgctcagcgcccgtgatttccaaaagccgttgatgccaacgacaactggaataatgtgtaataaggtcgtggcgggaatgagccagggatgcttactaaatagttgaacgacctgggtatgatgttcatgaaggtcgtcgtgaatcgttttaggtgttaacatgattgaaccacgctccttgattaagtaccattatcataccttaaaatgtaatcgttgtcattattggcgttaacatgctgatgatcgttaaagcgtccaccttaagttgatcacttgaggtgggcgcttttggttactttaataaaccttgttattaatcgtcagtcttattcatgcgactgtgccgaatgccataactgaagtaaatgacgagcccgaggacgaaccaggcgagtgatgccagccaggtttccatggataattgggtcatcatgaataggcaaagcaagccagaaataattggcaggactgggtaaagtggcacgcggaagcctttgatcgcgttaagttttggattacgccgcagtagcagaataccaaaggaaacaaaggcgaaggcaatcagtgtcccgatattaaccaggtttgccaattggtctaacggaatgagaccagcaagaattgaaatcacgatcgtaaccgtcaacatggcgtttttaggagcgtggtgcttgtcgattttccctaagaaacgtgggagcaagccgtcacggccgattgaatataaaagccgtgaactactgtaaatcatcgtgaccatcatcgtgaacatgccggcgagggccccaatcgagataataccggccacgaagttttgatggacgagttgtaaagcgaacgccactgcatcgtcaacgttcaattgcttgtatgaaaccatcccggtcaatacgcctgagacaagaatgtagaagatggtacagatgaccaacgtcccaatgattccaatcggcatgttgcgcttggcgtttttaacttcggcagccgacgaagaaacggcatcgaaccctaagtaagcgaagaagacgaccgcggcgcccttgagaattcccgtcccgccgaatggggcaaagggtgtccagttacttggtttaacataaaatgagccgacgagtaagaacaacacaatgattgctaattttacgaccacaataatattgtttaatcgaattgacgtttttaggccggtatcgataatccaagcaatcagacagacaatcagaattgcgaccacgttgatataggtcccgtgggcggggtcaaacgaaccggtgatggcttttggtaacttgaggccaaaaccagcgatgaatgaattaaaatacgcggcccacccaacggcaacggtcgcaacggctaggacgtattcgagtaccagagcccaaccaatgatccaaccgatcatttcgccatagacaatgtttccgtatgaatacgcggaaccggcgattgggagcaccgaagcaaactcggcgtaacacattgcggcgacggcacacacaatggcagccaaaacgaaagataaaataatcccgggacccgctttcgttgcagcgactgttccgggcagaatgaaaatcccggtcccaatgaccgcaccaattccgagtgcaatcaggtcgattgcggagagggtccgttcaaaatgactatctttttgtaaatagcgctccaaatcttctttttggaaaatgcgctggaaaatccccataacatggaccacctttttggttatttgtaacagttagttgtcattatcgacaaattgtcatgtcaatatgataccgtggttgattattaaaagtcaattagaatcagccttttattattaataactccatgggatgtgggttgcgtactagctatgcgccatagaaactggttgcccagcggctgcggtaccataactaatgccgacagtatccttttagcggtggcactcggatcctgccacggcggcattttaggaactcggcgacctgcgccgcgccatgctaacttgcccagccagtaagcacatttagtttaagccgttccgtggtctgaagagacagttggctagatgcaactactgttaatcattagttgatacttagtttaaacgaataccagtaaataaataaacgtggttaatacattaagctgttaattggattcgccaaagcttataatattgttatcaattaaagttaaattttagaatggtgggattaggatgggagcggcgattgatattactggtcagcactttggacgtttaatagctgttcaccgggcgggtcgtgctaagaatggcaatgcactttggttttgtcagtgtcaatgtggccggacgtgcgtcgtagattcctatgttttgcggcacggtaagacgcgcagttgtggctgtctggccgtggaacagagccggcaaaatatttttaataatccgcaggcagttttgcgtatgggagatccgcgtaacttgaagattcgtgaccaccatacggatgtgagttcactcaagaagtcaaagcgtaacacgagcggcgttgtgggcgtgagctatgacaaacagtcgggttcctgggtcgcccacttctactacaaagggacgtacatactaaacaaacattttgtgcattttgaagatgcggttgaggcccggcgtgcgatggaacggcaatatttgacaccatctgatcactgagcctagccggatgccgacagtgagattcgccggtgcgttccggcacagttgagaacgcattattttgagtggactgaagtcggctaagtgtgtggaaaacgtccccggacttagtctgatgaatacgaatgatgaactttaatgagttgagcaacgggactagcaacctggtgctcaactttttgattggtaaataagtaatcttaatgatgtaaatcctgtcatggcatactgtggccgcaataacgccagttcgagtcgtttaagcaaccattcttctgaagcgaaaaggttacagtcagtcggagttctgataaaataagcattacacgagataagagggggtagcaagattgtcaacaatgttagtggcggaagatttatccgcggtcggaggaatctcgcttagttcagcattacccgtattaacggcgatgcattatgacgtggcggcactgccgaccagcttattatcgacacatactagcgggtacgggacaccagccgtggtcgacctgtcgacgtggttgccgcaggtctttgaacattggacccgcgcccacctgcattttgatcaagccctgatcggttacgttggttcggttgaactgtgccaacaattaaccacttacttagaacaacaagcgctgtcgctattagttgttgacccggtactcggcgatctcggtcaactctatcaggggtttgaccaggactatgtagaagcgatgcgtcaacttatccaacaggcagatgtgattttgcccaacacgacggaggccacattgctaacggggacgccctatcaaacgacaccggatctagcggtcattttgccagcactgcaagcgcaattgaaaactggtgctcacgcggttattacggatgttcaacaggatgatcagattggttgtgcctggttggatgaagcagggcacgtacaatacagtggtgcgcgccggttgcccgggcattataacggaactggtgatacgttagctgcggtgattgcgggactgctgggtcgcggttatgcattagcgccgacactggcacgcgccaatcaatggttgaatatggcggtggcagaaacaatcgcgcaaaaccggactgatgaacggcagggtgtcgcactaggacgtttgcttcaggcaattttaaccctcaattgatagtggaacatgttatactagagcataattcataattaggaaggtgcgacttcatgagtacagaagtagctagtggtgcggtcgtctatcaacaaaaagatggtcatcccgcttatttattattacagagtgcgaccagtgatttttggggctttccgaagggtcacgtggaaggtgcagaaacgttagccgaagcagcgcggcgtgaaatccgtgaagaaacccaaattgaagcgacactcgatactaattttaaggcgtataccgaatatgacttaccgaatggcaatttgaagcaagtcacactgtttgtcagtgaagtcccaagtggcgttgtggtgacacgacaacaagctgaaatcagcgcaattggctggtttgactatgccgctgccagggaacggttgacttacgataatttaaagcaaatgttagatcaggctaacacctacattgagcagcatctacaataatagtgacgataaaaaaattactggtgccgtcgcataaacggtaccagtaatttttaaacaatatttttagattagcttaggcctgggtttgtaagtttgcaactgcatcttcgattgttacgccttcagcgaacaattctggatgaagtttgtcagttgcgacaaacatttggcgttgcgtatctaagacaatgctgaaccagctatttgttttttgaaattgcatatgacaaaactcccttctgaaaattgttggtttgctacgagatgcgtgaatcatctatttgaaccttataggtacgttactatactcggtttattgagttaacgcaaatgaaaagctttacatggattaaaaaatggaggtttagcgattttgacaacgaaacggatctttgtgatcacgggaccaactgggagtggtaagaccactgtcagtcattacttgcggtcacaataccaaattcctcaggtgattactcatacgacccgggcaccccgggaaggtgaagtcagtgggcgcgattattattttgaaacaccggccagttttgctacgaaacattacctagaacacgtgacctatagtggcaatcaatacggctcttcacgagaagggctagcggccgcttgggaacgctcaccactgatcagtatcgtcctagatacggcgggagcgatcacctatgcgcgggagttaggcgaacaagcggttgtgatttatctcgaagtcgctgatcaagaggcgctaattcaacgtttgaccaagcgtggggatctgcccagccgaattcaaaaacgagtcgcaagtgatgagtacttgcgtgaccaagcgttgccggcgggattagtcggacacgcgcacgttattgtgaatgatgactggcaagtgacgcagcgccagctagatgagttggtgactgagtattgtcagactaatgctgtgacgaaggattagcactgacacatagatgggcaacgtaattcacttttacacctgagtatgctaaactaaatagtaatgattatgatttagcagagtcctggtcagtaggaggcagcaacactatggaaacacccattgaacaagccgtcgcaattttacgccgtaatcagtttaaaattacgaagcaacggcaggcattattagattatctggtgacctatcaggaccactatgtggcaatttcggccgttgatgagcacatgcgaaccttatttgcaggaatgagtcacaataccatttatcgcaatattaaagagtttgaaacgttaggattattggaattgaaggcccaggctaatcaaaccctggttaaatatcaatgtgatttcaagcatcaacaccatcaccattttgtttgttcagactgtggtaaggtgacggaactgcaagcgtgtccgttagacgagtatgaagcacaattaccgggttgtacgattacgggtcaccgcatcgagatttacggtctatgtgccaattgcacgaaaaagcaggcaattaatagctgacggggagtcggcttttttgttggccttgtttgagtaaagagtttcttaatttgtgatagaattagtgcattccgaacacgagcatggtttaattatagattagaaagaataacggcaaagcctcagaagggaatgacatcgatggcttatcgaacaccaccatttatttcaccatttgcaattgtttcaattgtccttgcactgggggcaactaacgtggtcgttaataagacaacccatactgtcaatggcgccaaggccactagcagtgtggtcaaaagttcatcagctagttccgcaagtctgaaaaagaaagcggctgatgatagtagcgatgagaataaatccaaagacaaatccagttcagatacatctaatgatgaacagaatagtagttccagtagtagtactgacgagaatgatacggacagcagcagtgctaataagaccagtagttcatcaagttcagctgatgatacgagttctagtgccactaatagtagtacgactgataacaatagttcaacgactgatacgagtgacgatgatgaaagctctgctgctgagtcatcaagtacgaccgcgtcaagttcggcaacgacaacgtcacagtcgacaacggacaccactactagcgacgggggcgaataacgaatgtttagtattttagatatgatcaatcacgccttgggctacgttaatgtcaatgtaaagattaagaatcagatctatatcggcattggaattgcgggtaatttatacctcggttatgtggcaattcgcttgatgcagaatggcgcgtggttacggggcatcttatatatgctcgttttcttggcgctgatttatttcattacgttaaacgtcatttattattttactaataaaactgcgaagtatgacttatcaccacgtattgaaaaattgttgggtggtaagcctaaagaagcgttagcagctgaaaaacaagcacaacaaagtcagcaacaaccatacattcctgcgaacggtatttttgatgggcaggaattgttgcccgccacggtgaagacttcacgtgctgaacaggagaatgtgcatcaaatcgttgatcaactacaagcggcgaacattgttcgattagattacggtggcttaactgatgatgccatcattcagcaggcgcaggcaacgggtgaacccgtttatgcgattgggcaaggcattcaaattcctttttcgcagttaaagttggagaatcaccggctagttatttacgccggaatcaatcagatggaccaatccccggttgggcatattactaaggtcggcttgaccgatgttcatgatgcgcatgaggattataagttgtacttggcctccacggtaatcacaggtggtatgagcaagattgcgggccgaacgtcggctatcgagcaaccgggcgattaccaggtaaccgcgcaggttgcgtatgagggaagagaagattaagagtgcttccaaaggcggttagtttgtgagcattaacggtaaaacggtgatcatcctggttttggatgatgaccgttttattgttaagcggagcaaactgcctttggaagcacgtttcggtagccaaattgaatctaaacacaaaacaaccgttttgagcagtgactcgaaacggttgttttgtcggtatagctatttaaaaagcgtcaaaatgtctaatggtttttggaagcggtgggccacttcttgatggtcggcgttgggatccatcccccagacagccagtccgaaatcaacgttagcggccttggcagtttgttcgtcactgacggaatccccgatgaagagtgcgttttgcggagcaacgttgactttttcgagggccgtgagtaggggtaggggatctggtttgcgtttaggcgtatcgtccgcactgattgtgacagccatccgcatcatgaacggatatgaccgcatcccactttctaattcgtttcgtcgttgggaagtcacgataccaagtcttagttcagatggcaactgttcaaagaggctggtaatgcctggataaagttcgatctgatcataatggctggccatgacatcttcgtattgggcctgaaagtggtcaaactcactggcttcgatccccaattcagccattgcttgttcagcggccatgggaaaagtcttctgcgctagcgtaggactaaatggtttgccataagtagcaagtacctcacgcataaccgtcgtgtaagctggttggctattagtcagcgtgccgtcaatatcaaacattaatgcttggtaagtcatataatcgttccttccaaagtagatttaactccagtatagcaaattcgtccttgacagtggttaggacaaccattatagttagattaacaattgatgaggagctaatgatatgtcattaccgttaaattcattaaaatctagaactagcttttacttttggtattttcgctagtgtttgtgccggctgcataggtgcaaacacgaatccgatgtttgcatcgatgcggttgccaagagcattttgtgatttaacggcgcccatggatgtttgaaaattccaagggtggctaataagtttgtttctgcgtggtggcgcaccctttggaatttcaaggggtgcgcttttttgaccccattccagtccgcttccaccaacaagctcagccaaacttgggaggaatctttatgtcaattaattcagaaacacttgttagccatatgaatcatgaaattgcggcgattcagccgtccgatattttggcgttcaacgctgaaatcgcgaatattccggggatcgtccgtttgaccctcggtgaaccagactttaatacaccggagcacatcaaacaggctgctatcaagagtattgaagcggatgaaagccactacgcaccgtcgaacgggacgctggcactgcggacggctgccgctgagttcttggccactaagtatgatgtccattatgatcccgctagtgaagtgatcatcacagctggtgcgactgggggcatttatacggcgttgagttcgatcctcaacccgggggatgaagttctgattccaaccccgatctttccactgtacattgcaattgttaaattagctggtgcgacgccggtcttcatggatacttcagataatggcttcgtgttatcgcctgaccagttacaaacgacgttagcagctcatcctaagacaaaagcggtggtgcttaacttcccttcaaatccaaccggtgtgacttaccggcatgacgatttgaaggccctagccgcggtgctagctgaccaaccgattttcgttttgtctgatgaaatttatagcgaattgacatatggtgagcgtcacgaatccatcgccaattatttaccggcacaaactattttacttaacggggtctcaaagtcgcatgcgatgacgggctggcggattggtattatgtgtgcgccgaaagcgatcacagcgcaattgggtaagattcatcaattcactgtcacctcaacgacgaccaatgcccaggcggccgcgacggaagcgttaaaaaatgggttagatgatgctcaagtaatgaaacgtgagtaccaagaacgacgggactatttgtacgacgcccttaatgaacttgggttccaatcagcaaagcctgaaggggccttctacttattcagtaagattccagccggattaccacaagatagtatggcattttgccgtgagttggcccatgaagcgcgtgtcgctctgattccaggtagctcatttggccctggtggtgaaggctatgttcgaattagttacgcggcttcgatgagcgaccttaagacggcggtcacacggatcaagacatatgttgccagcaagaagcagggggcttaaagatgaaaatattaatgtatagtgttcgtgacgatgagcaggatgcgattcaagcgtgggctgcggctcatcaagttcaagtagatacgaatgacctggaatttcacccggaaaccgccgacctggtcaagggttatgacggtttggtcatccaacagcgtagccccattggtggcgatgctagcttatatcaatcactagctgcggccgggttaaaacaattaacgagtcgtacggccggcgtggatacaatcgatattccggccgccaaagccgctggtctcgtggtgacgaatgtcccagcctattcacctaattcagttgctgagatgtcagtggcccagaccatgcgcttgattcgcaacctagaaatgtttgaccaacgaatcggccaacagaatttccagtgggcgggactgcaagcacgagaaatccggtcattaaccgttggtattattggagcgggacgtattggtggtacggctgctcgactcttccacgggttaggcgccaaggtgattgcctatgacgtggtacgccatcccgaacttgaagacgttttaacctacgttgacactaaggaagacctgttacaacaggcggatgtcgttgatttacacgtggacttgaatgagacgtcggctgggttgattgatgcggcagctttgaagttgatgaaatcagatgcctatattatcaacgcctcccgcggcccggtgatcgttactgatgatcttgtggcagcactaaaggccggtgagattgcgggttgcgcacttgatacggttgagggtgaaaatgcgttattcaatcaaaatcatcagggtgaggtgcttcaagatactaacgtggcacaattaatgcagatgcccaatgtcatcattacgccgcacgtgggcttttatacgaatctggcggtcaaaaacatggtcgatattagtttggatgacgttttagccattctgaacggtaaaccgagcgaccacgccttttaatcatgaaccagcttaaagtgtgccgttgcgacgacaatcaagtgtcgcgccgttaagtggcaaaccaccacacggtacggcgacctgctagcaatgccctgattgtcagcatccggctagaatagtagccactaaataagccttccaggtattcacttggaaggcttatttgtcccttgaataggtgcttagctgccgggctcggctaaccagccgttatctaacaactggtgatagtgcttgccgattggaacccatagtttggcttgcagaatgctacggagttcatcccagaaaaggggatcgcgttgttcattagtggataaatttagttttaagtaggcgcccgtctcagtcttggcaattacaaagggataaaagactttgatgatctgggctgccataatattagtcatattcgctgcttggtcaagtaacatgttatcgtctcccatgaaaatgctgatgattaatttcttagtagttctaggttagcaatgaatattaaagaaatgattgcggaagcgttaacaaatcctaaagttcagttagttggagctactaattatgaaaattaagcgccggatgctacgccggctttcagtagtggtatgattagaagcgggttaaagcttaattattgcaataataaaagttttattaatatcattatctaaagcttgttttagcgtctacttttctcgataaaaagcgaattattattgacattggacgaataatgttcaatattgtccctggtattcagtcattttgactgaaatcaggacgacagtttctcactattttatggatatcgaacaatatttggctactttttgacaaaattactaattatgtattaaactatttaaatagcattaacgaagaataaggatttcttaactttaattattaatgcgataattctagaccgtcagtcaataggctgatagagaaagcgaaggtgactgcaatgtcaatgatcgaatttcacgacgtcgaaaagtattatggtgattttcacgcccttaaaaatattaatttaacgattaatgaaggtgaaaaagttgttttgatcggaccatctggctcaggtaagagtaccttgattcgaaccgtcaatggtttggaacgtgtccagtctggtcaattgttagtcaatggttttgatttagccgaccgcaaaacggatatgaataaaattcgcaaaaacgttgggatggtcttccaacattttaatctatacgctaacaagacggtgcttgaaaatatcatgattgcaccccggttagtcttgaaacggccggaagctgaaaataaaaaattagcgatggacttattggatagtgttggtttggccgacaaagcgaatagtctaccaagccaattatctggtggtcaatcacaacggatcgcgattgcgcgttccttagctatgaagccaaagtgcctcttgtttgatgaaccaacttcagcactggaccctgaaatgatcgatgatgtgttgaacgtgatgaagagcgttgctgaagactccagtatgactatgttagttgtgactcacgaaatgggatttgcgcgtgaagtggccgaccgggttattttcatggctgatggggaaatcttggaagatgatgccaaggaaaagttctttgatggtcaacctaccaatgaacgggcccgtcaattcttaggtaaaatcattacacactaaattgtaggggaggaccacgaatgaagaagctgaaacgactaattggcgcactcggcatgcttgccatgctagtggtggtcttaaccgcttgcggttcacggcaatcattatcaaaacaagatgtcttgaccaatgataaagctagcaagaccattacgtggggtgttaaagctgatacgaaattatttgggttgatggacgttaaagataaccaaatcaaagggtttgacgccgatattgcgacggcactaacgaagcgggtactcggcaagaatgcgactgccaagttcgtccaagtcacaagtcaaacacggattccattgttgaagaatgggaacattgatgccattatcgccacgatgactatcacgccggaacgtgaaaaacaggttgattttacgaattcgtactttgatgcgggacaatcactgttggttaaaaagggcagtgcgattaaatcagttaaggatttgaataagtcgggtaccaaggtccttggtgtgactggtgccaactccgttgagaacattaagaaagcagcgccaaaggctaaggtgttggaattgtctgactacgctcaggcgatgacggcgttgaaatctggtcagggagtcgcgttgactactgataatgggatcctatacgggatggcgtcgcaaaatccagggtacgaagtagttgggggtacctttacgaaggaaccttacgggatcgctgttaataagggacaggaaccgttaaagaaggctctgaataaagcactcaaagaaattgaagcggacggaacgtataaccgcatcttgaagaagtggtttggtaacgtggccggcttcgactataaggaggcgtcacgctaatgggatatattctaacgcactattggtcagagctgattcaaggactcggatatacgttgttatccagtgtgattgctttggtattcagtacgatcatcggaacaatgtttgctatctttgaagttttgccaagtcgtacgatgcgcatcattggtcgagtttatattgaaattttccggaacattccattgttagttattgcgatgttcttctacgtgatcattccaatgtatgttgccaagattgatggttttaccgcggggacaattgggctaacaatctatacctcgtcattcattgcggaaacggttcgggccggaattcaatctgttgattctggacaaatggaaggcgcccgtgctaatgggatgacgtactggcaggcaatgagtaaaattgtcttaccacaggcatttaaaatcatcattccaccgttgggcaaccagtttattaatctggtgaagaactcttctgtcctagctttcgtggctgggttcgacttgatgtaccaagcaaattcaattgcgtcactatcgcttgatacgatcaatagctacgtggtcgtaggggtcttttacttaatcattacgttgccactgagttattacatgcggcacttagagaaaaaattagcaaactagaagggggcgacgattcatgcaaaactttattcaagcgtattcgtggataaatatccggttcttgctcgaaggactctgggtaacggtggaagtgtccgtcgtttccatcattgccagttttattatcggttcagtcctaggggtgcttcggtacgtcaagattaaatatttatcggcagtggttgggtttgttgttgacattattcgaaacttgccattgatcttaattatcttctttacttactttggcttgccgcacttgggattcaagcctggtatcatcttcgcagccatcctcgccatgacgatttttgaatcggccatgttagccgaaatcattcgttcagggattttggcggtcgattatggtcagatggaaggggcccgggccaacgggatgagctatgtgcaggcgttatggcacattgtctttccacaagcaatcaagaagacgatcccaacgattgtgagtcaatttatctcactgattaaggatacgtcgctggcaaccattattgttttacctgaattattaaaccatgcgcaaattatttatggtcagaactcagcgtatattttaccgatgttcttaatgatcgcagtcatgtacttcattatttgttacgccttgtcaattctttcacgtgtgttggataagaagttagcgtaaagactggtagatcaaatagagtcattaaaaaacgtcagtcgtgtcggaaaatccgccgcggctgacgtttttaagttagtggcgcttgctaaaagggcgtggttactgaagatacttcggtaactacgccctttttatgagccagcgagaatttaaattaagtgttctgattttgctgccgcttccaataatagattgggaacccaacggctatgatgactagtgaaatcagtacgccggataagtctgagccaatttcactgataatcacgaacagcgcgcccagaatcgcaatcagcggtgtgattggaaatccaggtgtcgagaatggtcgctcagcagcagggtggcgttttcttaaaataaagacaccaatgaaggttgccacgtagaagcagtagaccgtgaagatacagagatctgataggcgatccgggttaaagaacagaatcataatactagcataaacgagaatggtaatggttgcgatgatcggttcgtgtgactttttgtgcaagtaactgagctgtttagcaaatggcagctgattctgagcagccatggcgtacacgatgcgggggaaggtcatgattttgccgtttaaacagcccaccatcgagataatgatcccgatgttcagtaggcgcccgccaattgtgccaaacgctgcttgggcaaagtatagcgtcgtttgttgcccaagtttgtggattgttgccgcgggtacgaagtggagaatcccgtagctgactaaggtatacgcaatcaagaccatggaaatccctaaaataatggcttgcggcaataacttctgcgggtttttgatttcgccacccaagttagcgactaggatccagccatcataggcaaatagtgttgcgaggacggcgaccccaaaactacctgttgattgggtaattgtatgtaaagactgtcccagcgcattctgattaccatagaagaggccaaaaataataatagcagcgatcggtaatagtttgcccaacgtggtcgcgatttgaaacgcggcgccccaccggttttcgaacatgttgaggatgccaatcaaaacgatgacaccaatcgaaagtggtgcttgccaactggtctgtagattgaagaaaccgacgagtaaaatgccgagataggcgccaattgaagcgatgatagcgggaccgtagacggcgatttgcatccaaccggagagaaagccccacaatttaccatagatttgttccatgtagacatagagcccgccggtgtggggcatttgggcaccgacctcggcgattgttaagcccgcggtcaacgtaatcagcccacctagtaaccaggcgagtaacgcagcgctcggtgagccggcgctttcaagaactgaggactgtttaaagaagattcctgacccaataaccgtaccaacgacgagtgaaagtgctgaccaaaaaccgagtgaacggttcagggtcgttgcttgttttgtttcctgcattaacctgagatcctcccttgaaacggccaaattctaaatgattcacttagcatatcagatattagtagcactgacaatcaaatgtcgggtgatatagctgatttttcactctaaatccgaactaataacaattttttaatagtaaagttcgataaaatgcaaaataatccgcgtcatttggttgatgattcaggttggacacaaaatggaatcaggcggtgtggcggttttgaattaatttatttatcttcttaatattagcagggttatttaacgggtcaggttagtcattaacttagtcattaattgagttagttgtgcccactcggattgattgagaccacccttagcagtcaataaatccggcaaatcatttaaagcgatccgtgttgcggttccctgaggtgtcagagtgagtaagacgcttcgttcgtcgttgggattccggtggcgtgtgattagaccagcctgggtcatccgctgtagcacgggcgtcagcgttcccgtacttaaatttagctgggtgctcaacgttttgactgggacggcgtgcggtggcgtcgcgtaaagtgcgactaggactagatattgaggataagtgagttggtgtacggtcaaagttggttgatagagacgttgaatggcgtggacggtcgtgtaggtcgaaaaacagacgtggtcttcaagggggcgaattgtgggtgttttcatgatgattaccacctttcatgtgatgagtgtttagtgcggcaacgttcttgataatggttgtgcacaatcgattgattggattatagcacattctggcattctgtgggttcagttacgctagcaacgggcggacccactcagcggatgaattgcgcgtacgaccggtaaaatgctgcgtgtgggctcgctggcaaggacaccgtggtcataatttttggttcatttgtcaaaaatacagtataatgctacgagtaggtaagagagtggggttagattgatggtaattgcaattgtggtgttgttgatgctgctcagcatcagcttatttgggttgctgttagccggtgccagacggcaagcagcgccattttttgaccacagttttggtttcggcatggttatcggggccgtgacggattttcttgacacacttggtatcggaagtttcgtcgtgtccacggcaatttttcaagcgagccattatttaaaggatgaacgtaagctacctggaactttgaacacgatgcatgcgattccgaccgcgtttgaggcgtttttctttgttacagcagttgcggtcgagccagtgacactgattagtttagttttagcagcaacgctcggcgcattactgggtagtgaagtcatgacgaagcttaatcagcggtggattcagttaatcatggccggtgcgttagtcatcactgctttactgatggcagcgaagttattaggttggatcagtttgctgggagttgctaatcaggcgacggggctatccggttggaaattattggtcggcattggtggcaactttatcctagggttactgatgtcagccggagtcggactgtacgcaccgtgtatggtaatggtgtattttctgggattgaccccgattgccgccttcccaattatgatgctgtcgtgcgcattgttgatgccgatttcggcagtgaattttattcgccatgaccgcgtcgattatcgcggcttattcggcattattttaggcggtattattggcgtggtggtggcagcgaccttagttaagtcactgtccttaacagccctgagttggttgatcgtcttagtgagctgttggacggccttttcgttatggcgtgccgcgcaacgccggaaaaatgtgttatagtcaacggtatgagtggttaggctaaccaagcctagccacttttttgtcgttgtttaaaatgatcgtcaggctgctagaaaaaataacggtcgctggttgacgatttatacagctggctgtataaatgaaagggcaggtgattaagatgaatcatgatgaaatggtggcgcggcaagttctgattttagctcgtcaaatcaagcggcgtcgcaaccaacatttgcggacggtggggctaacgactgagcaagcggatgctttgaccttttttacggatcagccaggtcgcacggtaaccgcgtttaagacgtatcaggagattacccatcagacggccaggatgatcgtgcaacgcttgcagacgcgcggatacgtctaattagtggtcagtccaacggatgcacgtgccaagcaagtggtggtgacccaaagtgggcgtgccaaacgcgagcagctccgtcaacatggctggcagacgagtgcgcaaatgtttgcccatttggatgccaaacaacaacaggtgtttttagacttgttacgacaagttaatcagaatttagagagtgatgagaattgatgaagacgcgtttatatacgccggatgtaaagttagtgttaatggccagtttcttctttttaatgagtccaatgttaattaatcccgtgattgcaggatttgcgcacgggattggtgctagtagtgtgcttgccggtacgattgctgggttgacgaatctgacatcgctagtgctccgtccactggctgggaatttaaccgaccgggtctctaagtaccgtttgaccttcgtggggggctgcttgttgctactagctagtttaggttatagtttgacaaccaacgtgacgttaatcatgttattgcgaattttgaatgggttgggatacaccttgtgttcagtctgtatggcgacctggatggctagtttattgccacccgatcgaattggctctggaatgggcatttatgggctagccaatgcgcttggaatggcgtgcgggccggcaatcagtgtcttcttgtatcaacattacagttaccagagtgtcttttggttagccgcgggctgtagtttactgctcgtcatcatgattcaattcgtcggtgatcatggtgaaccaattgtgacgccgcaaacggctacgactaagcatcatattcgcatcgtacaaccacgagtaatccccgtggccttgattttgcttttattttcattaccatattttgccacccagacctatattgttagctacgtcgctgcacggcattttcatgtggcagcgggggtatttttcccggtgtacgcgggtattttattagtattgcgacttgttcttcgcgactggttcgaccgggtgccatttaaacggttcatctggttatgcttaatttttaatctattaggattgattggcttaactgacatgaacaattgggcgatgctactgctgggtgcagcaggactggccgccggatacggtttgatgttttcaatttgccaagctaaagcattgatgctcgtgccgaaagctgatcatgggctagccaatagtacgttttatattggtgttgatctcgggatgtcacttggccccatcattggcgggctgattagcagtcaattaccaatggcgtggttttatcccgtgatgatggtgacgctgccattgattatcgttgtttacctagtcagtcgtcggcagttagcttagccaccaacatgctggagaaggttgttcttggtatacacatgattatgaattttttcagtggggatatcaaaaagtcacttcaagtttacgactgcctgaagtgactttttatctgcctttatataaacattttgatgcaactgctaagattccctatgaattacacgtcttcaagcatggcccccacggactagctctggcaaatgatcaaacagcatggaaaccagacgccaatcagccccacgtggcgcactggttaacgttagcgctcgaatggctagctgataatcgttagttttctactgacggctactagtaagctctaatataagttgtaaacaaaaaatcgctcgctttacgcgattcctcggttggtggcaatccccccgttgagtcgtcttaaagcaaacgatttttttattttaagcatattattcagtcacctggacgacagctggataataaattagattaagtttgttaattgtctttataaatatgagcgatagaaaagcggccactttaataagccgggtgcccagaaaacgtagaaccactgcatgatttgactccaagaccacgctagtagcacggcccccagcgtatcagttggataatgtgcgttcaagtaaatgcgtgaaaagatgactaatagcagccacacaacgctcacccacttgacgatcatagccattcggtagctgggtaactcgggaacgaccaacatgataatcacactcaccaacacgaaggttcctaggacgtgaccactgggatagctatatcccgtatcctgcgccaaatggctgattggacgcgcacggccgataatgtgcttgacgataaaacctaacaccatcgcaccaaccatgtatgccagtgcccagaacgcttgaatcttatacttaaacccgtacattagaaacgccaggattatgatccacaaaacgtccattccgggtgacgccaaccaagcaatcaccttgtaaaacgccgtccaaataccgctgttgctaatttggaccagtgacgttaaggccacatctagtaaatcaataccaaccgcgccgtcactaataaaatagcttaaataggcaaataaaattaccccaatgacaaacttgatcggccgactacgcgacttatcgatcatcaaaacaagaacccccatttaatattaaaattaacaaaattataccatagtctattaatcgactgaacgaatcattaatatctctcagggaaccttaaaaaaaaacaaagaattcccatttttatcacgttttattaacaaaaaggttatgatctacctgacagtcatcggtaatcaagctaaatcttacgtggattcagttcccgctgacccgaaaaaatgctaaactatgaataactattaccattggaggaagagttcatggaagacatgccaagtcgctcagaaatgcatcgtgagaaatcacaaggaaacaattcacaggggaacggcaacgggcccaagaagaagcaccccgttcgcaataccgttttaatcattattgccgtgttattagttgggaccggggcctttgccgcgcgaacttattttaacgccaagaatgcggccgacaccgtcttcaagagtagtggtattaaaaagagtcggaatacaagtgccgtgttaaatggtaaaaagcccgtctcaatcctattactcggaactgatactggggccctcgggcggaactacaaaggccggactgatacgatcatcttagcaacgatcaaccccaagactaagacaacgaccctgatgagtttaccacgtgattctgaagtggctgtctccggtttcgaacaggacttcccgactaagttaaacgctgcctacgcttatggtagtgccggaacgaccatcaagaccgttcaaaaatggttgaacgttccaatcgactattacgccctgatcaacatgggtggcatgaaaaaagttgtggatgaaatcggtggcgttgacattactccaattcggacatttacctacgaaggttacacctttactaagggccaaaaagaacatatgaatggtgccaaagccttggcctattcccggatgcgttatgatgatccactcggcgactatggtcggcaacagcggcaacggcaattaatcaccgccattatcggagaaagcgccagtgcttccaacttgcttaaacaagatttcttaaattcacttgctaaacaaacgcggaccgacttaacattcggtaatttaactagtatcgtcactaattaccggagcgctaccaagaacatcgtctctgatcacgcccagggtactggtaagatgattgacggccagtccttcgaagttgtttcccagtctgaaaagcaacgggttacaaacgtcttacgtaagtctctgaacttaaaggctgcgacgaccggtgaaaaatttgctaaccaaaactaacaatttgatttaatgatgggacttgcgcggccccgttaatttaaaaggaccaactaaactgctcagtaaagcagcttagttggtcctttttatctcttaaatttgaagcgcacccactaacctgggcatgatttgaccgagcctgccacaagacacaccgctggcaaactcagtggccgcttttcatgaccgcagtattggcccttcacttaagcggtcgctaaccacaccgcgccactcacgagttacgacaaatcaaaccagggactgttcacgactccaatcgatgcaaccgccactgccgaatacaaaaggcaatcagccggttaagtaattcagccaataggaaacccagcgcaatcgcaccggtaatcatgatgacctgcaacgtgaatgagaccgcctcacgataattccctagcgcaaaattacgcaccatctggtaagcctggcttccgggcacgaatgaaaccaagctcggaatattgaagataatggcgggcatcttcttgtagcgtgctgccaaactgctgaggaccccgataccgaccgagccaatcaggcttcctaggacgaccccgccatcgaaagcctgcacgatcaagtagccaccccacgtcaaggtcccaatccagcccgcgacgtttagtgcttgatgtgggatattaataatcaggccaaagcccagtacggcaatgtatgctagcactaattgtccaatcgtgcccatcatgatccctccaaatgtccgggtcactgcccgtccttaaaatagtgtgatgacaacggcgattccgaagcctagcgctgccgcactcagcatcgcttccacgccacgtgcagggccactgacgaaattaccagccagagtatctcgtacggcgtttgttaatggcactccgggcactagtggcatcaacgacccgataataatatcattgacattggttccccacccaatctgacacacccattccgcgccaaacccaattagaagtgccgccgttaactcgctcaaaaatttaattttaagataccggttaagcagataaaagaccaagtaacctaatgttccaataataacagttggccacgtattaacaatttcctgacgaaacataatcatcaaggggccactgactaaggctgcaccgaccaactgcaaccacaacggaaatgagcgcgaagctgcatctaactgattaagccgttgatataaagttggtaaatcaatggtcgtagccgcaaattcacgggataactgattgacctgtgccactttttcaagatcgatcgttcgctggttaaccgcggcaatctgcgttgcattacgtccttgaatcgacatcatgacacccgtaatcgtcacgtaggtattggcagcaacaacccccgcattctgagcaatccgcatcatcgtatcatctactcgcgaaatctccgaaccattctcgaccatgattttaccagccttcaagcaagtcgcaataatcatctcatcggttgtcactgtcatcccaccctttaataatcagaattacattctctaataattcttactttagccaatgtctggctgttagtaaagctttatttatgataattaagcatccgctgcaaaacgacaaaaaaccggtgatgagaattaattctcatcaccggtttaagccatttaagctgttaattatgcttttgtaacgttaactgcttgtgggccacgatcgctttcttcaacgtcgaagtttacagcttggccttcatcaagactcttgaagccgtcttcttggatagctgagaaatgtacgaatacatcgctaccgttttcgcgagtgataaaaccaaaacccttatcagcgttgaaccatttaactgttccgtgttccataataaaaaatcctcctagtgcattttgcacgtataaaataatgtaaatcatgattcggtacaaatggggatagtttattgaaacgatctgaccaaaattacctaaccaagctacaagagtaattgtagcatattgtttctaaaaaaggtagctaaacaccattatttccatgaaatgtttatgcgacgataaatgaaacagaataactaactaacaaatcgcagttttgttcggaaatagccgctaatcacttactttacaaagacgttatgcgccgctttatagctaactgggatttcctcgcccgttttctgaatggaaacggtaacagggccttcaaatggatcgtgttttaaaaccgtgacctgctgtccaatcttgagcggcgtatcatgcaaataaactaataaatcatgattatcaataaatcgctcaatcgtaaccgttgtgccatcctgcgtatctgctaaactcacatgactgtcttcctgataatgaccatccttatcgggaatcgcgccaccatgcggacaatgcgtcggattgcctaaaaaggcttccaaagaatccactagccgttcactggtcacatgctccagcacttccgcttccgtatgcacgtctggcaaatcataatccaatttatcaactaagaaatcttcccagattcggtgcttgcgaactaacgtttcagcgtagcgaatgcctttctttgttaacgaaatcccagcatacggggtatgcttagccaagccttcctgaactaatttaccgaccatctccgttacagagccggccgcgatgtctaaacttaaggcaatttgcttattcgacaccttttttttcgtaccaccaagctcgaaaataatttttaagtaatcttccttcatgggggtcatgaatattcttcacctcaactaaatagttacttctgactctctctaaatataattctaacatcttactacaattaagacaccagttctagtctctaataacgacaaagctttgaaataattgcctaatcgtgacataattaattgtagcgcaaaataaccaatttggttactaatttagaaacgtgcttgttcaactaaggaggaaccgcatcgtgaatgatgatgctcaattatcaattacgcaattggatagttctttgcagcacaaggcagttgaagactttgccgcattctacttaccactttttgacgctaacaaccttgaaatgatgtccaactatgatgttgccagttatatgacagacatcaatgaacaccttacttacggccgctacatgaccaaggctcagcgcttgagtgataccgttagtttttcatttaccgcctacgtcaacttgattgatcgactcgatcaacaatactttactagtggtaatccagcactaccatggaatgaatggttagccgccaagtttgctcaaactgcgacatcttaacaattcctacttaattaacgcgcgctactcgtgattatttcatatagaagtagaattaatactaaatgaaagacaagcaccacgcgtacttatagattatttaaagagattgagttgatactcggtctcttttttgttgataaccacactgatagattacgttttaacgtacgaaagtacaaaaaagccccaagctttcccgcagcacttgggacctctggtaaatatcatcaccgggcgattgaagactactactagtttcaattacacgttgttttatgcacgattactacctagttctagctaggcatctctcagcgcttattcgcgctccgttgtaaatccttttgcaaagttaaacttcaaaacacgaccaacatgacaacggtcaacccagccataagatcggttgacgaacgggaaacttaaatgcccaagtgacttaccgacatttaccaacttaaatttaacattaattaatcggttacacaagctgaaggttgctagcgctctgacttaacgggataaagtcgataatgtggcgtctcatcttgaatataacaataaagctgttgtgtcttcgcttcgtcaaaatatcccaacttgaccatgtggtgaccatcccgttcttcgattccttgaaaagccgtcatcataaagatgcgcatcatttccatttggttattatacccatcggcccgctcgacagccgctgccagtgtaaaaccctcgtctaacatcatcttgataaaatgaacacgcatcagcataccatacgaataacgatgcgtggtattcttctcactcactttaagactatgaatataatttttctgttcccagtaacgtagctgtgtctgagagacgccggtcatcttcgccaaatcgctaattccaatcgtaaattggtgcttgcctagttgctccttaaattttttaaaaaatacgttatcttcttgattgttcacaggtcaacctcttttctgacattttcagtactcagtatattatttttaatattaatgtcaagtttgttgacaaagtcgataaatccgattatattagacaacgtacttttttagagagaagggatttacttgtcaactcctgttgatacgcatgggaaaccttataaccgtggcttgctcattgcagttttattagttggtactttttgtaccgttcttaatcaaacgattttaaccactgccttcccaacgttgatgaaagatttcgacatcacaacgtcgaccgtgcaatggttaacaaccgggtttatgttagtcaacgggattatgattcccgttagtgcgtggttaagttcgcggatttccactaaatggttatatctttccgcaatggccattttcgaagtgggtactattatctgttggacagcaccaaactttggcttcttattggctgggcgtttgatccaagccgttggggttggggtcaccatgccattacttcaaacgattatgctatctatcttccctgctgataagcgtggggctgccatggggactgccggaattgttatcggtttggccccagccatcggtccaaccttatctgggtgggttatcgacaacttatcatggcgtgatttatttggtttgatcgttccaatcgtcgcaatcgttctaatcgctggcttcttcttcatggccaacgtcttggaaacgtctaagccaaaattagactttgcatccttggtactttctaccattggttttgggagcttactatacggcttttcatccgttggtgacaatggctggacgtcaaccgtggttctctcaactttaattattggtgttatcttcatcattggttttatttggcgtcaattgacgatggaaaatccattcctccaattacgggtcttcaagcatgccgagttcacaattgcagctattttgagctcagttgctaacatggccatggtaggggccgaaatggttattccactttacctgcaaattattcatggtttctccgcctttgaatctgggctatcactattagctggtgccctaatgatgggggttatgagtccaattaccggccgggcctttgaccgttttggtgccaaacgcttggcaattttagggatgtttttactgacaatcgggaccattccatttgccttcattactcgtaataccgcaacggtttacatcgtggttctctatgccgttcggatgtttgggattgccatggtcatgatgccggcaactaccgctgggatgaacgcccttcccgttgaactaatgggtcatgggactgccgttaacaacacgacgcgtcaaatcgctagttccattgggactgccatcttgacttccgtcttatcaaacgttacggacgccacaaaaccagctcatagcttgattaagagcaatccacttggttatcagaacagctatttcaacgcaaccttaaatggttaccacgcggctttctgggttgccgtgggcttctcagttgtcgggctcgtcgtcgcgttcttcatgaaaggcaagcagcattccgttaagccagtaatgaacactaaggaggtgaacgactaatgattctcgtactactcgttgttagcgcaatcgcgctcttcttatcatttatctacgttcaccaaaacacgttacgaatcagcctatccgttatctttgcggcactcttagtgacctcgatcgtcttcgtctccaagaatgatggtcaacattacgggatggtcaaaacaacgacgaccaccacgcaatcattaaagtctgctggtagtagcaagcaacttgatttattgctctatcaaagtgtgggtaccgctgacaagcaccgggtctatatttataaaaagaccactaatcagaaaaaagttagccatacgacagccagcgtcaagactgctaaccaagttaagacgacgaccgcgacacctaagttagttactaagacgacacggtggacttataagagtaacgccatgaagttctggtttggcttagccaacaatgacaaacagttgatcaagcgaaccaactacttctatatcaataagaactgggtcgtacttagcacaacccaagctaaacaattcagtaaattgatgaagcaacagcaagcgacattaaaagcgcgtgctaaagtctacgtgactaatcaggtcaaggccgcaatggtcaagaacccgacaatgagcaaatcgcaactcgcaaaagttcaaaaagcagcggctgctcaatatcaagccaatgccattcagagcatgcttaaaaccgttaaagctagcaaataacttgaactaacaattaaaaatagctgacaagaccccggcatgccggggtctttgttgtctaaagatcatcatggcttgtccccccctttcactaacgtcttgccaaaactagcgccggcgccccagcgtcaagaccacacttattcaaaatcgatgcgccggttaattatgccggtggtttacaaaaaattcacgtttcttttctgaaaatgtacactatctttactaaaacatgattttgatgctttcgagcaaatgatacgattatcacgtaccaagttgattgttacgatgtcattagaaagtcagacgtctaaaggaatgattacgtgtactatcactcaacatcaggattgttttggatcatcatcgcccttttactttatatgcttagtaaaacagaccctaaaaattttataattaagcaaataagacgatttggttggctgatcaacttggctattctgacttacattatcgtcaggcaaattcagcaacccactggcgtattacaaatcatggtcttaatagtcatcggattttcaacaatgagctcgatttacgctcgctttaaacatcagccttaatcaacgctaagataaaggcttgcccgtgagcaactggtactcagacatgttcggcaacaaactccacgtaagaaaacaagcgtccgcgttgatctaatcaacgcggacgcttgtttttatgtcgcccataactgcattattaaaactgtcagacgatctttggtgattttaccgctgaacgactaacaactagccgacgcaaacagccggtcggccactgacggttgaacaggtgccgggttgagtagactctcggcgtcatcgtagtcatcatcatcgtcatattgatcatcagtatcataatcgtcgtcatcagactcactatcagtatcatcatcgtaatcgtcatcggattgggtttcgctgtcatcggcgtcatcacgattcgaatcttcatcgtcatcatcttctgagtaatccgaatcgctgtcagcatcgctattagtatcggaatcatcgtcggtatcgtcattcgaatccgtatcttgatcactccaatcgtcatcagccgaatccgcgtcggtgtcgttcgtgtcatcattcgaatcagtcgtttgctcatcccgatccgaataatcgtcattatcgtcggcctgatcggcatattcgtcatctaattcttcagcagcatcatccacatcactatcgtcggcaaaaagtgccaaaatgaaccaatcgggcacatcgtctaatgctgccatgttccacttgtttttagcggcagcaatcttccgacgtaacgccgctgctcgtttcgcttcagccgcactaactttcatattcgtcttggccttttttgccgcagtcaataactgttttaccttagccttcaacggtttcaaatatggctttttatcccagttgatggctgcgcaacgtttgagcacgtccgctgaatagttgccgttcttcacctttaactgtgctttaacatcatctgacaattgctgatattcctgataatcactggttacggtgactttcaactgtttcagcttattcatcaaacttgttgccccgttcgtaatcttgacacccttatcaaccgtcgtcagcgccgttttaacttttccggccttcaactccgatgtggtcgtcaagtaggcctgcgtttgatcccggtacgcctgtgccttttcatccttgggcttctgcgctagcgcgttatcaaaatacgtcagcgctttttggtatttattctcagcaaccgcatttaaccccttctcgattgactgcgaatacgccttgttatggcagccagctaaaccgaccaccatcaaacataacagtatcaataacgatacccgctgcttccccgatttcatccctacttcactatcctttttggttggtatttatgcttcaataagtataccgttagtccctcaatcctaccagcccatataaattcatttatattccgattgaacacttggtgctccaaaacaccaatcaggactaatcatgattaaaacgtgccgattaggtggattcctgttcgtcagccggtgagcgtcctattccgacctccggggctgagtgacaattgctggaacgtagccgacgtcgatttgagctaacgcacaacccgcgtcatctcaaatacgagtcttattctaagccggaagaaattcacttccgactaagaataatttggctactgagcattgtcacccagcccctccagtcgggaacccgctcgaatggctgatgaacagccacttaacttggtacaatttgtcgttggctattttaacacgggaactttaagtacaatatcaggatgtattctctgatttgtcgaaacgttcaattattatgactggtgattccgaaatagtgagctatcacaatatcactttcagtctgacagttgattaacaaattactgtttgtaaaaaaacaatgacaagtccactaaatgttgggtacgcacacgtctgccattcgaatactatcccgactggaaggcgtttctgacaatgccaagtggtgaaatttcacttagcaagcgtcttgtgcttggttagtgaaaggccagtacttgagacgtggtttttcggctcaaatctgtgcccaccacgttccggcaattggcagaaatgcctggaagtcggcgtaggacgaaccaaccaaataagtttacgctaacttgaactttttccagcgggcctaagctggctgcttttgaacttaagtatcggcacgttctaatcatgattgtttaataacgatgagtaataaaaaaacaatcgcaccaattctagtagaatcggcgcgattgttttgatttgcttgtttattgagctgcacactgttcacaaagtggcattaaatctttcagatcctcgacggatgagccattttctaagaagcaattgaccatatctagccaatattcatcgtcagcactaaaatgtgcgttgacatccttgcaaggtaacaacccggcattggtataggcgacgattttatcagcagcgaccccgctatgggctgctaattgttccagagtcattttctctcaccatttgtcctttcaaaaaatcaatgtgattatgttacgcccccagcttttgaaatgcaagcaacaatttcgtaacgtcgcgattaaaagtcaatgataattttcttcattattttcaccgaaagtagtaaactaactcttaacccgcctttgcctcattcgtcaccctactattggcggatatcaagcgtgctttttcatcacagcacgcactcaaacttaacctacatagttatcctgtttcacgaaccacactaattgtcagataatcccatttagtgctggttaacgcatacttattgaatcggaggtcgtacatttatggattctagtttaacctttcgcgcgggcatcaaagatgtcattcccaccgtctttggatacattggcgttggcctagcaatgggcattgtcgccaacacgagtcacctatcagtttgggccgttctgctcatgtcactaatcgtctatgctggttccgcacaatttattatcgtcagtatgctcctagcaggtagtccgatttcggcaatcgtcttgtccacttttttgattaattcacgcatgattttaatgagcatgtcagtcgctcaatatttcaaaaaagagtcgttattgcaaaatatcggactgggatcgttactaactgatgagaccttcgcgctcagcatgaacaagctcaatcagaccaatcaacaattaaaaacgagttggttacacgctgctaacattgtggcttacttagtttgggcagccgcgacagtggtgggttgcctccttgggaacttgatcactgaccctaaccagttcggtctggacttcgccgttgttggtatgttcattggtttactttacttgcagatcatcacggatcgcagtaaatcattgccgacccagttgtgggtcgtcctatttgtggccctcgccatgtattttctcatgcgttgggttccgggcaacttggctttgatctttgcgacgctactcggttgcggttttggaatggtggtggaccacaaatgagtacttacatttttgtgaccatcttactctgcggcctcgtgacttggctatcacgcattgtcccgtttgccatcattaaaaatctgtcagtcccccaatggctaatcagctttttatcatttgtgccagttgccattatgaccgctatttttgttgaaagtctgctcacctaccatgcgggacactggccagaatttaatctcccaaatatttatgcctcaattcctgccattcttgcaggagtgctcaccaaaagtttactggccgtcgttatcacaggcatcgttgccatggccgtattgcgcctagttggctgggcttagagtgcaaggccacatctaatttaatattcccacttaaacgtcccgcaaatttgtgcatgagtttgcgggatttttctgtgactcattctgggatcagcttatttcaaatggtcctcaatcggggctttagtctatcatgccagcgctgccgcctcacactcaccaaataatcggccgaaacctcaccgctaaacggccaatgaacaggtcaccagcagactggacgtttcacgcagcatgaaattttcattaatgaaagcgttccatctatggtctccgctttatcttatgaattaaagcaagtataatagtcaaagtgtacgccacggattgtcaagcgcaattataatcatcattggtaagaaaccgttataattgtccagattgctttacatccgtgagtgaaacgggtaaattaacaacgaaccatctgtacacatatagtagataagaactgtctaaactttaaagattgagagatgaacagacatgtgcggttttgctggttgcttaactgatcggactaaagcggataacgcagcttacgatcagaccatccacgaaatgactaaaatgattgtccatcggggacccgatgatgacggttattttgctgatgacaacattaccatgggttttcggcgcttaagtatcattgacttagccggtggtcaccaaccactatcttatgataatgaacgttactggatgacatttaacggggaaatttataactacgttgaattacgtgaacaactcaaacaagaaggctatgaattcaaaacaagctccgattctgaagtaattcttgcgatgtacgccaagtaccacgctgacgcaacgaagtacttacggggaatgtttgctttcgtcatctgggataaacaagaaaaaacgttatttgccgcgcgcgatcagttcgggatcaagccgttctattacgctatcagtggtgatgacttctattatgcttctgaaagcaaggctatttacaagattctcaaagataagaccttcgataagaacgccttacaagattacatgacgttccaatttgttcctgaaccagaaacactcacgaaagaaatcaaaatgctcgccccgggttgctccctgactaaaaagctaggtgctgcgccacggatcgaccggtattatcaccgtgaattccatccggtccaacgttctgaagacgagtatgcccaaaaaatcaaagatgccttaattgactcggttaagattcacatgcgctccgatgtaccagttggttccttcctttcaggtgggatcgactcatcgatcatcgtcgcgattgcgaaaaactttaacccgaaccttgaaacgatctccgttggtttcgaacgtgagggttacagcgaacttgacgtcgctcaagaaaccgctgaaaaacttggtgttaagaattacagcatgacgattacgcctgaagccttcatgaaggctttcccgcactttgtgtggagcatggatgatccgttggctgatccggccgctgtgccgcagtacttcttagccaaagaagcggtcaaacacgttaaggtttgtttgactggtgaaggcgctgacgaactcttcggtggctacaccatctatcatgaaccagaatcattgaaaccgttccgctacacgaaaccgattaatggtgccttgaagcgtatcgcactcatgatgccagagggaatgcgtggtcggtcattcttactacgagggaccaccccattagaaaatcgctatgttgggaacgcctttatctttggtgaacaagaaaaacaagccttcttcaagaattacaatcagaaccatccgttccagtccatcacgcaaccgctctatgatgaatccgtcgactatgatccaatcagtcggatgcaattcatcgatatgcacacgtggttaaacggtgacttgttgcataacgccgaccggacaacgatggcgcacagtttggaactgcggaccccgtttgttgaccgtgaagtgtataacttagcagccgaaattccagctgatcttcgaattagtcacggcacaacaaagtacattcttcgtaaagcggtcgaagacatcgtgccagcgcacgtccttcaccgtaaaaagcttggtttcccagtaccaattcggttctggctcaaagatgaaatgtacgactgggctaagcagatcattaacgattcgcaaactgaccaatacttcaataaggactacttcttgaaactcttagatgaccacaaggccggcgttcgggataattctcggaaactctggacggtcctcaccttcatgatgtggcaccgactctatgtcgaatctgaccacttgatggatagccccgaagctaacgccgttgcggaaaaagtcgaggagttttagatcaatggaaattattgttcaaaagttcggcggcacgtcagtcaaggacgaagccgcccgtattcaagctttaaagcacgttcaatacgccgtcgatcagggcgataaagtcattgtcgttgtctcagcaattggccggaaaggtgccccttacgccaccgactcattactcggattagttggggccgagcactcccgcttaaccaatcgagaactcgacatgttggtctcagttggggaaaccatctcgaccgctgtctttaccgagttagcgcgtaagcaaggcctaaacgtcacggccatgactggtcatgatgctggcatcgtgactaacgacgattttcaaaatgcgaagattctccgcgttgatccgaaaccaatcacggacgcctttattgacgccgacgtggtagtcgtaactggttttcaaggtgctactgagagcggccacattactacgattggccgtggtggttccgatacatcagcagccatcctcggcgccgctttaaaagcaaaacgtgttgatatttttactgatgtcaacggcatgatgactgccgatccacgactcgtcacccacgcccgcttcattaaggccatcagctacgaagaacttgctaacatggcccatgaaggtgctaaggtcattcatccgcgtgctgttgaaattgcagaacaagctcacgtgccgatgcggattcggtcaacttatcaggaacccgacgaattagggactttagtcactgaccggaccacgacccaaatcgaacattatcgtaccgtgacagggattgcacaccaaactgatttgacgcaatttactgttcctaccgatacgttaagttcaagtgccattttccaattgatggcacagcacggtttgagtgttgactttattaacattacaccacaccaagttgtcttcaacctggttgatggtgacgcggacgttgccaagcagctactgactgacgcgcacgtccattgtcagtcaattgcgaactgtgctaaagtttccgttgtcggtgctggtatcactgggacacccggcgtcactgctcggatcgtctcggcattagctgcacaacatatcgatattttacaatcgaccgatagttatacgaccatctgggtgctcgttaaggaagccgatttaaaagcggccatgaacgccttacatgatgagttcttaggaatcgaataaccatccctgcaagtccggcttaattgccgggcttttttgttgacctagattggcctggagatggcacgttcaaccagcagcacaccatgtaccgagcgattacaagcataatttcaattctcatttggggtgacaattatccggtttgcatgtattctagaaacagtaactttattgaaaaggacgctaatattatgcaagcaagtcaattaattaatagtttaaaattcaagcaggttcagcccgccttgaccacggactttgatgtcaccatgctgacgcaggatacccgcgaagttcagcccggcgccatgtttattgccgtcgttggttatcacgtcgacggccacgacctcgttgatcaggccatcgaaaaaggggccaagatcatcgtggcgtcaaaacctttagacgtcaacgtaccggtcatctacgttgaaaacaccgaacgcgctatggcaattctcgccgacgttttctatggggcacctagtcaaaagatgcgaatgattggggtgacgggtaccaatggtaagaccactgtcacccacctgatcgaacaaatctatcgtgaccagcagcaagccacaggcctcatcgggaccatgtatcgcaagatcaaggacgaaaaactgccaactgccaacaccacccccgacgccatcacaacgcaacggaccctagcggccatgcgggatgccggtgttgaaactgtcgccatggaagtttcttcaattgccctcgtactcggacgggtctgggggattgattacgacatcgccgttttcacgaacttgacgcaagaccatttggatttccacaaaacaatggctaagtacacggaagccaaggccatgctctttgcacaactgggcaataagtacagcgccgacggaactaataaggtcgctgttctgaacaccgatgatcccgttggccgtgaatttgaacagtacacggcagcgcacgtactgacatttgggctcaaaccagatgccatgatcaacgcacaaaatgttgaaatcaagagccatgggactgaatttgacctctccgtcttcggccacgtaacccacgtgacgatgcaactgattggccagttcaacgtgtacaacatgctggcggcctttgccgcagcttacgctagtggcatccccgaagaccaaatcattaagtcactggagaaggttaccggcgttaagggccgcttccaatccgttccttcccacacgggtgtcagtgtcatcgttgactactcacacactccggacggcttattgaatgccctagaaacgattcaagatttcgcgactaaggatatttattgcgtcgtcggctgtggtggtgatcgcgacaagacgaaacggccaaagatggctaaaattgctgtcgaacacagtactaagccaatctttacttctgacaatcctcggatggaagacccaaccatgattctaaatgacatggttgccggcgtgccaaacgccgacgtgcccgtctacgaagaccgccacgttgccatcgccaaggccattgaagcagcacaacccggcgacgttgttttaatcgctggtaaaggccacgaagattatcaaatcatcggccggactaagcatcactttgatgacagtgaagaagccgctaaagcactagctctgaaaccaaccattgattaatggtcaaaacagaactgaccgacaaggctattttcaattctatttctgttaacaattggtgacatccgcgacacgcgtctttaaccattaacacccccagcaacagctaatttgattggccgttgctgagggtgttttttgcttgtttggctttctcccaaccagcgctacaaaacaggcatcagtcgtgtttgtacaaaagatgcacccacctttcgattattaaccagccaaactatcgcctatctttgataattcacctaattcggaaatataattatgttgataaaaggggttaattatcattgttagtttaagtttaactcgtttggggggattcattatgtcaatttttcaaacttggaaacgtcgtattgcttatggttccactgacatggctggtaatattatttggcaaatggtcagcacttacttactgttctattacacaacggtcgcgggcatctcagctgcttttgcgggaatgctgttcttcgtcgtgcgcttcattgatgcgtttgatgcattgatttatggttatttgattgatcatacccacacgaagtatggacaatcgcgcccctactttgtgtggtttggcattccgttagggttgctggccatgtcgctattcatgattccatcatttggcggcaataccacaatgcgactcgtctacatttcaatcacttacactttctttagcctgatctattctggtgccaacacgcccattacttcgattttaccaagcttgactgatgatagcgttgagcggaccaagttagcgagtgctcggatggtcatgacaaccatcgggaccagtgcagtggcggccatcactttgccaatggttaaaatactcggcaaaggcaatcagtcgaaaggtttcaccctctgggctattatcttaggcctcgttatcatgggactcttcatctttgcttttctcaatctcaaggaaactaacggtgcacaaaatccagacggtaccactgagtcagccgaatcactctcaatctggcaaagcttgaagggtgcggctagcaacaaaccatggctattattagcctgctcattcattctgctacaaaccttctggatgctacggggaaattcagcgatcttctttatcaaatacgtctacggtcggcctgaattagcgccaattttcctggggattggctttgtttccgtcatcgggaatctgtccgtaccattcctatcacaacgctttaagaaccgtaacgttttgcagttttcactcgtactgggcgttatcggccaactactgctgccaatcgctgaaaagatgcgtagtgtgagcctactaattgctggctccgtcattttcttgattgcgatggggatcacgttcacgattgtcttcgcgatgctatcagataccgttgactactcaacgaaagtactgggcctaaatgaaaccggattcttatctgccgtaccaatgattggcgccaaattaggaatgggaattggcggttttctagccggtcaatttctcgcatggggacaattcaatgccaaggcagctgtacagtccggacgaaccattacatttattaatctcgcttttatttggatgccgattattttattagccgcgatgattttcatgatgcaattctatcggttagacgaaaaagaattacaagccaacaaggccgacgcagcgactaaagttgaacctaaggaggatgttgaatatgatgccaacaattaattcgattcaaacaaccgtcaacggcgtcgtcaaaatcgttaaaccatttaacaacgacatcgccggtgaacaatttgacccacacgtccttcaaacactaacggccttcaaacaaccagccatccttgaaaatgatctagcggcgctccgcagtggtagtttaacccccgccatcgcggaccctgttggtgatgcggttacagttcaaagtcgaaatattacggctctgaatcgcacggtcagcgttgaatggctgacaccacaaaatgtcattaatcacacagtactggtctacttccacggtggtgccttttacggcggtgttcccggcaataatacggtccttttaaagctggtcgcagctaaaagtcactgcgagattcttaatgtcgattacagcttagcgccagaagcaccagcacccgctggtattttagacgggctcgcgattttccaatatttggaacaacgtgacgctgaaacaatgattaccgttgctggcgattcggctggcgctaacgtcatcatggccgcaacaaatctgaatcaacaactcggtagcaatcgtatcaatcaacaactgctgttgtacccagttaccgccccaaatgctgaccacgccggtccactctgggatttggccgcctttccgattattgactcacagcgtgccattctcactaactatcacgacctctttcggcaacttgacagcatcatgacggattattatgttccagagaactttgattcacattctccactcatctcaccgctacaccaggaaaacttcacaatgacaccaccaaccacgatcatggtcggcgagtttgatcccttccgaccacaagcttgggcttatgcgcaacgcctggccgctaccgatactgcgactacgtttattcagtatcagggcttgaaccacgcttttgcaccattagtggatcagtattggcaaagtcaagatgtggcccaagtgatggcggccgcgttaatttagcgaccagggcatatcaaaaatcaccagtatcacgttgcagaaatcatatgtaaaaaacaagcggactgataaaaatcgccccgcatttcacgatccgaaatgcggggcgatttcgcgttaagctaacctttaagtctgagacttgtgctatactcttggcatggggggattaacgtgaacaaaaatgataaggccaaacgtttaatgcaacaaatcgacgtcgcctataatgatcctgaagttaaacaagacgcacaagttcgtgctgacctacttcgctatgccatggaactcgacaagaacggtaactatttattaattgccactaaagttaacggcatggcaatgcgcgtcatgcgtgatcacatgcaccaaccactccaagcaattaacacactctacacccaaaccgcccgcacctccgaatattattggggcgtggcggcagctagtatttttagtgggctgtggtaaagcactatcacgtgcgagcgctcactataaatcacattaacaacagttttgaaccggaacacagacaaataacttgaatcaaccgttaatttcaaagggacgctcctgacaaaccatgccagaagcgtccctttactaactacttaaaattttatcgatcagagtcaagttaacagctaaagtaaggcgttgtacttggctcagccatttacttcaagtacccggtttcattccaagtcgtcagttcaaaatgctgattatccgtcgtcgataacactgtcaggctatcattatccacgataccgtggccgactgtcttcataacttgcccatcgaccacaaaaggtgctcgtaattctgctacgggaacacccattaacgccttgacagtcatcgtcgtcaccaggccgtgcgatacgattaatagtggttgcgtgctagctaccccaacttgatcaatcaaacgatgtagcgtcgaagtcgttcgggtgacaaaatccgcataactttcgccaccgccagctagttccggtcggtattcggcgggtttagtaaaaataacttgggcataggactgcggctgtacttccgcttcctgtttgccgtcccaatcaccaaaatcaaactcacgcaagccatcgtcgatttgaatcggcggttgccactgattggcagccacaatgtatttcgccgtatccagcgctcgttgctgcggactgctatatactgctgaaaattgggtggtgcttaagtaatcaccagcggcctttgccccatcgattccgctagcaaccagcggggaatctgctcgtccaccttgaaatcggtgttctaagttatattgtgttcgaccgtgacgaatgaaataaatctgcatggcacgttcaccttcctaatccgttcaatagtttaattctaactgtgtcatgctcaatagaaaagtcttcagtgccataatgacgtaaaaaaataccgtggtctaagaaacacaccacgatatttcagttattatgataaaggcttaaccaagtgctggtacggatgtgtgccaatcatgagctgaccatccgggacaaaaccatgccggtggtataacttagctgcccggggattgccatcatcaacgtttaaactcagtttcgtggcccccagttgaccaacgagtcctggtaatgcttctagtaaggcactaccaactccgtggccctgagcttgcggatcaactgccaacatgcttaaataccactcattcggccgggtctcaccacctaattccagtggtgcctcaaaccccgcatgatgacctgaagtcgtccgcaacaaatcgtttacagcgacttcattcttcgctaagtgcccaaacgcgacaccgacgattttgtgagccatgaccgccacaaaagtctgcgctaacccatctaaattggccggtcgctgatacaactcagtcaacattgccaataggtcggcctcgctaacattttttaaaactggcatttccatatcacggtaaatcatcgcaatcaatggtgcaatttgagcactatcttgcggttgtgccgttcgaatttccatcatcacaacgctcccaactgttttctcaaccgtagcaaatcccgcggtcatcgtcaatcgttgtgcttaatttgttgccgatgttgaatcgtcatcacccacgtcgtgacgggaactaccaggataacgccaattaacgagaataataccattaatacttccgcaacaaatattttattattgataacactcccgaaggaataatgtaagcccgcaaaccagataaacagcgccaagaagccaccaaaaaagccgaaaaacaaggtattaaaagtcgtcccgataatctgcttaccaatactgataccatcgatatagagtcgcttagttggcaactgcggatgctgcgccagaatctcactcagaccagccgcaatcgcaatagcagcttccgcaatggcccctagtgtacttaaaattgcttcagttaccgctacgccaataaaggacactccgattgccaatgacatgccttccaaatcttcactatcttccaaactaaagccctgcgccatgatccagttttcaacgggaaaaataatcagcactaacatgaccatgacgatcaaagctgcaatataagctggcttggccgccacttcgttgtcctccccaaagaaaatcgtgaaggccaagatgattgtcccaatgaccaacgacacccccattgctggaaagccccatgaaatcaaaacaacggctaaaaacaacaatccaaagttaaataacaaactcaaaaaggccgtcgctccagtcttaccaccaattaatgtcatcaaacctagtaaaattaatcctaaaacggtaatcgtgttcatgccatcaccgccttaggcatcaatcgactggctaaccaactggctactggaatcgctaaaacgataccgataccagaaatcaaactttggaccatccccaacgacatattcattgtaaaagtgtaaccccagctattgccgttacggaaatagagcaaagtcatcgcgaaagtatccgccatgaaaatcaaaaatagcacgttgatcaagggccccataatagaccggccaatttgaatacccgacttaaatacttgtcgtggtgcaatgtccgggcgctccgttttcaattgaaacaatgaagcaacaatatctgttgattcatccatgactgctccgagtgaaccgaggactgtttcgactaaaaataacggtcggggaacctgcgtcacgtactgcatcgattcataagtcacaccacgctcatgggtcaccgcaaagacgatcagactaataatgacagccagtcccgtgccaaccacagtcgcgcccaatgttactaacatttgacgactaaaaccgagaactagcaacagtgtgagcacggcgaagattacggccaatacgccaaagagcaggtaaatgtgaccaccattagtagctaaatcgatctgaatggcggcataaaatattacagcattgagtgcgacactcaaaaaggccatcagaccgctgaaacgcataattaacaagagcagtgctagggctaaccacgcgacaaacgccaatgcggtatctcgttttaacccctgaatcgtcactgcactactatgatcgctaggaatccgtaagaagacttgattacggacgtgatacggctgatccattgcgcccgagcgcgtatacgtattcttgatctggtaagttcgaccacgatgtgccttattgagcacccggaccgttaccaactgtgtcactgtcgcatccttattctcaaattcatccgtcgtcgtgcttcgactcttagtctgcacgtgggtcacctgtgcaactgtctgctgataaagtcccgcattaacccgggtcaatccaaccccgattagtcctaaaacaatcaccagcagtgttaaccacaacccccaccgttgcttgattcgctgtttcacattttcaccttttttcacttcaatggtcaccagtttaccacccattccccaatacaaacttcgattctggcaatctttaacagaatctaagtttctacggtaatctaggccgttacttgaacgcgtaaagctttcagccaagcaatttcttcctcatcgtggaggcgctgagcaatttttagtcccttttcaatcaatgctagggcctgttcgggctgctgatggacccgccattcataaacggcagttaacttataatgagccaaaggttggtaacgacgtaataactgttgaacaccatcatcttgataccatgctatgatctgggggtcacgatgattggtgaccaagttccagtacaatgtcgcatctaaatacttcgccaaatcagctggcggcaacgtattgaaacttggctccaagcgactcaaccccactaacagttcgggggtatccagcccatgttgaagtccccattccagaatcaaccaggcttgccggacgactaaataattccgattgccaccatcgcgcggcataacaatcatactcgcatcaaggtcacggacactaccggtctgaaccttaacggccgcagcacacgcagtgacatacgcggcggtcatcgccgccgttgattcgcgtgcctgccgaaattcctggcccgccgtgggataaccgtgcaagttcattggtaataattgggcggctttcaacgtattgacccagatccaaataatgaacgcaaacaaccataaatcgaaactaaacttaaattgattcagagttattaaactgagcatgaccgtcagtaagttgaacaggccaccgccaaaacaataaatggcgtgattgaaccgtttggcatccgccgggggtgctgccacgatatgtggatgacgcgtcagcggtcgttctaatttccaatgaccacgaacccgacttaattgaagtcgaaaaccggtaatccggacaattcgagcaccaattaatcgaaatccgacccactgaccgagccaatggattaacgtcgcacctagttcgctggcgactagtgccaatcctagccaaccgactgttgcaataaattgtccaaaaacttgcatgctattcctcctcgtaccttgattgacagcctttatttaacaaaattaattttgaaatcaataacacgtttttgggcatgacccatgattagtttttgacaaagttagattcaaaaaccggcagcttggatgtgccaaaaccgaaaccaatcacagcatgctgccaaataaaaattcatctaatttaacatgttttaattatggttcatacgcctggcaaccagtaccaagtgtcctcattttctaattcgacgataccatattaattatacgcgtggacactgaaataatcgctggtacttcgtaattgctcttattatagcaaaacaagctgacctccggcgattaagacgccaagcccagcttgctaatcaattgaattttaatgtcgttgttgctgaatgcacatgccgtattccttaacgacgccggtgtttaacaacagtgaagaaatgtaaaatcattgctaaaagaacataaaagacgacgacaaagacgccgtagtaggcccaaaaattgttcagcggaatcaattgttgaatccccgcttcgattcccattgttagtagtgccatcaccgcaatcatgaagaataattgaatataccgtttcaccgtactgtcatccctttcctttttatgtgcagcccgcgcgccgacccgttcacattctgcttgcttagcagctgtgatggtttgcataccccacgttttagttacgacaatctcccgtaatttgatgagaccacccatcgtcaaaaatttatcaagtgttttaaacgttgcgtcagtcacaccggtcaaataattttcaataccacccgcgtaacaatccgtgatcgtcacataatgcttgttcttaaagcgatcaggtactgcttcacccacggaattaaaccgtgcgatccgcccccgaaaacagtcacagaagtttttcattacccccgataagctccccaaataggttggtgcagctaatacccagacatccgccgccattaattttgcttccagcgcgtctaagtcatcattcggttgactatcgtgatctggtcgcaactcataatcgttgaggttgactagttccgtgtcagcgctggccgcggccccctttaagacggcttgcagtagctgggcagtcacgccatcagcgcgatgcgcacctaatattcctaagactttcacattttccactcccatcattcattcaaaagctatttttattttaacgcatttcaacataaaaatatggttatcaaacgaacagcgattgttaaacccgctaatagtacttacttttaacaaaaaggtttgacaatcgattaacgacttgctttaattatacataagtacgaacgttccaataacaattagtctaactgacaacttgtagacttaaagttttcttgctgcaactatttcaccagaacttgaacatcgagctgtcataccaacacttaacaactaattcagcgtactgccgatggggggagttagtccttaagtgtaaattgaatttgaaaggacgcagtcaccatggctaattttcaacaatccgaaacggcacttattgaaagtgccacactaattaatatcttcgccgaaaaaattcggcgtcagattatcattgctctggggaacagtgataatggtctcaacgttactgatattaccgccttggtcaatatttcacgccccgccgtttcacatcatctacgcttaatgcgtgaagctggggtcattgatatgcgtagtaacggggtcgagcatatttattttctcacgttaaccgcaccattacagcaattacaggcaacttttgcgacgctaacggctgataacgcgccacttagtcagtcgtaagcactagcgcctcattcaatagtcaccgcaaccttcaggataacgcgggcctgcaacttacccgctaaacgttagcttgattttagacggttgccaaccaaaaatcggcactgccagaatgttcaactcattctagcagtgccgatttttattaaccattcatcccgatggtcactggtcctaagctgaacttagtcgtgattcaaggcttgcagatcagctggcaatgccgcctcaaagtgtaaagtctgttccgaaaaggggtcaaagaactgtaaactagcggcgtgtaaggcttgccgttgaatccacgccaagttaccgccatacagcgtatcacctaataaggggtgcccaagcgccgttagatgaacccgaatttgatgcgtccgtccagtcacaagttccaaccgtaaccgactcacgttatgctgcaattggtccgcctccacttgatacgtcgtaatggcgcgttggcccgccgtagtgaccgctcgccgaggactgtcagccacccggccaatcgggcgatcaattgtgccactagccggcgtaatggtcccttcgatccaagcttgatacgtcttcactaattgcgccgcaattcggggctctgtcagcatcccctgcgccacccgatgtttagcaactaacacaaggccactcgtatcccggtccaaccgcgtgatcaggtgcggtcgttgattactggcatgactggctatcaaataacccttgattcgattgaccaacgtatcggtccgattactaggccccggcacgctggttaacccggctggtttattaagaacgagccaattagcatcttcatactcaatttggattggttgttcgctgacgactaccgctgtatccggtgcctcgtctggtagttgaattcccgcaatatcgccatcatgaatggtaataacgcccgtttgaacttgattattgacaagaaacgcgccggtgccatgcttgattgccttgattgttcgcatactgatggcatgcgtcgtcaagaatcgtttcattgccattgattgcccctggtgttgccaagtaaattgcatacgtgttactccatttcatctcgtagtttaccaatcagccatctaatcagtttcctcatcggtgctagttgctgattccgcatgagctgccgctcgaatcgtcgccataaaggtttcaccatacttttcaagcttgctggccccgacccctttgaccgttaagaaagctgcgtcgtcttctggcatcaggtcacacatcgaatgaagcgtccggtcagaaaaaatcacaaatggtggtacgccctgttcttccgccaattgacgccgaagtgtccgcaactgttcgaagagggcactgttctctggtaccgtctgttgcaccttttgggccgtctttcggtgtaccgtggtcgttcctttaagcacggccactccactcgctgagactgtcagtgttggatactgaccacccaccgactgcaaataaccgctcgcagtcaaaaaatcgatcagttccacgacactcttctgtcgctgcccggacatcaacccgtacgtcgacaacgtattgaggttcgattcgcggacccgttgattattagcgcccgtcaatacctgggccacgacccctttaccgaactgggaatgaagcctaacgacgcacgataagacttgttgagctgccgtggtgatatcctgtgattcccgctgatcagtacaattactacaccgaccacacggcgcggatttttcaccaaagtatttcaagataaactgttgtaaacagccctgggtattcgcataccgtgtcatcacctgtagcttctgatacgccaggtgtcggtgctccgtatccatctccgactcatcaataaagaagtgctgaagttgaatatcaaccggtcgaaaaatcaaaatcgcttcactaggtaacccatcccggccagcccgaccggcttcctgataataagcttccaaagttccggggacttgcgcgtgaatcacaaaacgcacgttactcttatcaatgcccattccaaacgcgttggttgccaccatgacgtcaacacggtcgtacaagaaatcctcttggttttgccgccgaaccgcatcgtctagcccagcgtggtacggcgtggccttaatatcatgctttcgcaacaaactcgtcagccgcatcacttctttacgggtgctggcataaataatcccggcttcaccatgattaactttcaaataatctaaaatgtaacggtcggtatcctgatccttgaccaccgtcaaatccaagttattgcgggcaaaaccagtattcacttcatgttgtggatcaatcgctaagcggccgcaaatatccgcagcgacttgctcagttgccgtcgcagtcaaagctaggacctgcggatgggtcggcaattgttcaatcgccgtgctgagcgctaaataactggggcgaaaatcgtgcccccactgtgaaatacagtgggcctcatcaattgctaacagttggatgggcaaccggcccagcgcttgaataaagtaatccgaatctaaccgctcgggtgccacgtaaagtaaggtataatctcccgcccgtagttcttggagccgttcgttgatctcttggaaatccagtgaactgttaataaaagtcgccgcgataccattatcatttaacgcgtctacctgatctttcattaaagaaatcaatggtgagacaacgacggtcagcccctgaaaaagtaacgctgggatttggtaacataatgacttaccacccccagttggcataatcgctagggtgttttcaccggccaacacttgttcaatcactgccttttgccccggtcggaattcatcatatccgaacgtggtcttcaatacttgctgtgccgccgctaagtcaatcatcacacgtaaactccctctttgaattaatactctcattctaccgagaataccggcccatgacaagaacgcgccccggtaatcactaggtacgttaagtcgcacttgcgccacgaaagctatcaaaatacccaaaagtgcccgtccctattgattttataggaacggacactttaaagagaccgatatcgattaaacgaccatgtcagattggccatcaaagggcactcgcccacacagtttatatgtacaatgctgacttagccttgcttgggtcggccacggtgatccaccaaaccttccatgccgtgttgtcgatattttcgtacccaggtatagacttgtggatacgaaacattaaaatgcttagcggcttctcgataatcgttgcaatggttcagcgtatactttacgatcgcaattcgttcttccagcgttgcgcgtcgtcctcgatccatgactcggcctcctctcattcactactattcatcataccaagagttctcaattttttgtagctttttccccgtgacttgactgattcgttgcgatttttaataaattatttcgaatcagtccagtgcacctagcactcatcttaaaataaatttgttaacgcagttattttgcttgcattaaagaacgtatgttcgtatacttatattgaggtgattagcatgcagtcagaaaatctaaccgttaaatatttaaataaaagcaaaatattaaagttggacccctttatgttgtacttacaagtcacgccattaaaggctaccgaacctacgccaatcaactgcatcatcgtcaaacacgcgttaactttattttaccaactccagcctgacgcccaactggcactctacggtcattataataccaggcaccaattcgtgattaccaaattcatggtgcgatctgcagtgcaaacactagccagttaatgtacaaagccgctaaaatataagtacttagatcagaggagctgttgtcgatgatgccaacgaacctaaccttacttgagcgtaagatctcaaataacttgaattgtctatactttgtcaaccatcccgtttaccgtattcaaaaggaccatcaattagcactcgcttcagaatacagccttgccggcaacgtgaccgaaattatctgtgatgaacagcagcgctatcatattttattcgtggcgcgtaaagaaattgtcttaacggaaaagaaggtcgctaaagtgacgaataatcagctcgggcaggatactgctcagtttttggcggcacttgggtaccagttacccaccactcagccaaccggcgaactgagtcaacccacgattttaccctcaccagcagaattaagtgaatttccgagcgcttatgtgatcatcgactgcgaatttggtattctctttcggcgcagtggcaccgctaaggccatcaattggcacgtcattgaatcccccggatcacgagcaagtatcttccagctgagtgccatcggcttttcccatcatacgcaaacagccccctttttcaaccgttacttcgataacccgaacttcttacctgacaagaagttggccggcctagcagaaactggcctaacgaccgtcgcttatgaggcacaaggcgatcccttatcgattttaaaagcgtttatccagcaagtcatccagccgcaaatccccctcgttttttgggaccagactcaggatatgaagcacattcgcttattactagcccactattaccaccagttgactcccgctgaacagcaattagtcagtcgcccagtcgcgatttttgacgctcaagcctatacgaacaccttgatcaatcgtggcaatcataaaattggcaatcacgacctaccattgaacggcttggcagcactctttaacatcagtaatccacaccaacataacgcactttgggatgttcagacaactgaactagtcatgattaagcttgctgaactgacgcgtcagacaccggtaatcaccgcaacacctgaaccagtcgcattaccgagcaccgtaccatcagcgctgacgcccatccagacaataagtcccgcaaccgcgcacgccagccacgcacaggttcaccagttacgggcccgtggcaagacttaccgtgaaattgcggcggccaccggttttagtattagcggaattaattatattctcaaaaaagcccgttctatcccgacccgctcagaaagcgtataatgatattaatagcttaaaaggagtgttttaatatcatggaaaaacgtatcaaaggttcatgtaccacgattctcgtcggtaaaaaagcctcaatcgatggctcaaccattatttcacgaaacgatgatggtcacgaagccctagaccccgaacgattagttgtggtcaatcccgaagatcaaccccggcactatcagtccgtcattagtaaggtcgaagtcgacttacctgacaaccccttacggtatacttcaattccaaactcaatcttgaccaatgggacctggccagcagcgggaatcaatagtgagaacatcgccatgtccgcaaccgaaaccatcaccacgaattcacgtgtcttgggaatcgatccttttgtggccggcggaattggtgaagaagacctctgtaccctagtattaccatacattcacagcgccaaggaaggcgttactcgtctaggtgccctgcttgaacaatacgggacttacgaaccaaacggtatcgctttttctgatcaagacgaaatctggtggttagaaaccattggtggtcaccactgggctgctaaacgtattcctgacgatgcttacgtggttgctccgaaccgcatgaatattgacgatttcgattttaacgctgatgataccttagcttcagctgaccttgaacaattaattgaagattaccacttgaatcctgactttgaccgtgtcaacttgcggcacatctttgggagtgcttcaatcaaagatacggtttacaacaacccccgggcttggttcggtcagaaatacttcacgccggacgttgtgcaagatccaatggaacaagacttaccattcatctgccatgccaaccgtaagatctctatcgaagacgtcaagttcgttttgagttcgcactttgaaaacaccaaatacgatgtttacgggagtggctctgaagctgacaaaacccttttccggccaatcggaatcaaccgcaaccacgatgtgcacatcttacagattcgcaacaacgttcccgcggccgttgccggcattcactggttagccttcggtgccaatacctttaacacggtcgtgccattttacgcaaacgtcaatgacacaccagctagctacaaggatgcggatggcacctttaatctcaaccacatgtactggttaagctgtacaaccgcccttttgggtgacaccgactacgacttttacgtggacatgcggaatagttacgaactcgaagccatgagtgcttaccgtaaaatcgagaatgataccgacgctgacctggctaaccaccaagacttcacggcctatctcgaagcggctaaccaacaattggccgataccgcgatgaagttacaaactaaatttctcggcgatatggtcattgccggttctgaaaaaatgaaattacgatataatttgaatgattaattaagcccggtagcttgcggttttagctgagatttctatggtgaatttatgagactaaactaatttatttttaatttagtggtttacaaataccagaatcgtgctaatataaatgtcacaagataaaaaacggaggaaagaggagtacgattagtcaacctgccagtgaatcgggagtgagtggaaacccgaccagaacttgactaatccgaaaaacactttcttagttgctaactgaaataacctcgttaaagtaggattagccgttaaccggtacgttaccatcggtggtgtatgtttgtacactattttaaagctggtttactgtaaggtaaacaacttgggtggtaccgcgaaagagtctttcgtcccttgataattcaagggatggaaggctcttttcttttatcctgtaactaaaatctgcatttaattttaaaggagaccacgcatatgcatttaattattccaaaggattacgatcctaaattatccgttaaagaaacccaacaggccattcgttacattcgtgaaacgttccaagatgaatttgggaagcaactaaacttatctcggctttcagctccaatgttcgttgaaaagaaaaccggtctgaacgataacttaaacggtgtcgaaaaacctgtctccttcaccatgcaagacatgggtgatgaacaaatcgaaatcgttcactcacttgctaagtggaagcgggtcgcattaaagcgctacggttttgacatgcatgaaggtctctacacgaacatgaacgctattcgtaaggatgaagatttagacaactaccactccgcctacgttgatcaatgggattgggaaaaagtgatcagtaaggaagaacgaaccgttgaaactttgaaagccacggtacgtcaaatctttaaagtgatcaagcacatggaacacgaagtttggtacaagttcccacaagccgttcaccacttaccagacgaaattcacttcttaaccactcaagaactcgaagatatgtaccctgacatgaccccgcgcgaacgcgaaaacgccatttgcaagaaactcggctgtgtcttcttaatgcaaattggctggaagcttgattccggcgaacgtcacgatggccgcgcccccgactatgatgactggaagttgaacggcgatatcctcttctggtacgaaccattagaccaagccatcgaaatctcaagtatgggaatccgggtcgacgctgaatcaatgaagaaacaacttaaagacgtggacgccgaagaccggcttagcttgccataccaccaaatgatcttgaacgcggacgtcccttacacgatcggtggcgggattggtcaatcacggctctgcatgttattacttggcaaagcccatgtcggtgaagtacaagctgccttgtggccacaagccatgatcgaccaatgtgccgaacataacattcatttactttaatctgatttaaaatccaacaagaaggagtgatcaatatcatggaaaccattagtattatcaacgctgctgaccatgtcgatgaacaagttaaaattggggtgtggctcagtaataagcgttctagcggcaaaattgcctttcttcaattacgtgatggcacagcaacttttcaaggggtagctctcaaaaacgagctcggtgaaacggcttttgcacaactgaccgacctcgcgcaagaaactagcctctgggtcaccggcacgattcatgcagatacccgttccccctttggctacgagcttgccatctcacaatttgaagtggttgggactagtcacgactacccgatcacgcccaaggaccatggtattgatttcctgttggatcatcgccatctttggctacggtcatcgcgtcccaacgcaattatgcggattcgcaacgaggtcattcgagccgtttatgagttcttcaatgaccgcggttttattaagattgacgcgccgattttgaccggttccgctcctgaagggacgactgaattattcaaaactgattactttggtcaggacgcctatttatcacaatccggccagttatacggtgaagctggcgcaatggcgttcggcaaaatcttcacgtttggaccaacttttcgggccgaaaaatccaagactcgtcgccacttaacagaattctggcaacttgaacctgaaatggcctggatgcatcaagatgaaagtctggaagtccaagaacaattggtggcctacctcgttcaagccgtgattgaccattgcccccacgaactggccgttttggaccgcgatgttgcgacgttgcaaaagtacaccaagctcccatttccgcgagtttcgtacgacgatgctattacactactccaagcgaacggctttgacgtcgactggggtgtcgactttggctcaccggaagagacatttttggcagaacactttgaccaaccagtctttgtcttaaactatcccaaagcaatcaaggccttttacatgcaggcacacccgacgcgcgatgatgtcgtcattgcagctgacctgttagcacctgaaggttacggcgaaatcatcggcggttccgaacgctcaacggattatgactacttgaaggaacggttactagccagcggtcaagacttgcaggattacgagtggtatctcgatttacgcaaatatggttcggtgccgcactccggtttcggtatgggtctggaacgttttctggcctggatcaccttgcaagatcacgttcgtgaaaccattccgttcccacgtatgttgcaccggatttacccgtaaagtcgtttcaaactagtgctagtggcaccggttaatcaagattaatcgtgcaccctttcagttccccacgcattttcgaatgtgtggggaacttttttgtcaaatttgttgacaagcaacaatattcaagataaaatgttgcttgtcaacaaaactaaggagctgtttaacatgacaaaattattaatgattaatgcccatccacacacgaccgtccccagtgcctcactgaccgttgcagcgagttttaaagcggcgtatcagcaaacccatccgaacgatgagattacgacacgcgatctttatcaggaccgcgttcccgctttgaacgacacgaccttcgaagcttggcgtaaacaaaaatacggtgaagaactaacgtcaacggaagctgaactacttagccgtcacgctacctggctggctgaatttctagcagccgacaagatcgtcttcgttaatccaatgtacaatcactttcttccagccgaacttaaacaatacttagacttaaccgcagtcgcccgtaaaacttttaagtacacggtcaacggcccggtcggcttattacccgacaaacacgtctacattcaggctgccggtggctactatcaccaacctgatcaacacaaccaggttgaagcaggcgacccctacctccgtggcatgatgcaactgtatgggattcaggattaccgaaccatcttcattgaaggtttggaccaatttccagaacagcgagaacaggccatcactgccgcacaggtagcagcagaaaaactcgccggtgaattttaaaaccggtataataatagtaataaaagctaatgattaattgataattgcgcgctaaccaccacgagaaccagtcgccgtgacgcacaactatctaagggggatcaatcgatgtcaatatccacggaacagaccattctaacgcagctcaaaacgattcgaaccaagcgtgcttccactactggtgaacagaaatggttacagcagcatatcaccgaagccaatctacgccgcctgttgccggatatttccatcgttggcctacatttattatctgaactagaggccggtccacaaacgggcatcgacttagccactaacctcgctgtcactcgaggtggtgtgacccgggcagccaaacgactcgtaacgcagggcttgattggctcattccagcaacccgatgatcacaaaaagatcttctaccgcttaacgccgagtggtcgtaagctggcccgctatcatgataagatgcatgcaacccgcaatcatcaagcaatcacgctcctccatgaacactactcaccagcagaacttgcggtgattcaacgcttcttggctgatttgacggattatgaagcttaataaaaccaaaaacaccgctacgactaatgcgttcgttagtcacagcggtgtttttgaatttctaatgattagtgattttgtaaccgatacttgcgaattgccataatcaatgacaacgtgttgagtaccaatgataaactgctgaggatcaaactcgtttttgtaatacgcatgagcggcctccattgattgaatttgttaattctagtttaccggtattacgcactaaaagatactaaaagcactaggtgattcgtgggttgtgcgatcagtggttaatcatttgacacggtctgtttggcctgggatagcgcgtccttgactgcggccttgatggcacggctcgatacagaagcgccggaaactgcatccacatcataagtgttagcagccaccatttttgccggcaattcggcaactgcctgaccaccaacttcaccagtctcatgttgttcaacaacttcaacatgagttaattgttggtcaacatacgtgatacgaaccacaacttgcccaccaatgccatcatctgagcgccctaagtattggtgttcaccaactgtgatgtccggtgatgcttcagctagcaaatcattggcaccagtctgatgcaccgaagcactagtattcgcatccggcttagccactgctttttcatcgactaattgtgtcgtttcttccttaggtttagctgcattttcaccagcgatttttccaaaaatcaggcattcagctaaattaccgccaccttgatactgatttgcacaaataccgcccaactcacctgcaccatacaagtgcggaataggttgctgatttgcatctaaaatctctgcccggtcattacgacgtggtcccccttgggtattaagtacgttgtttgttaacttaagcgcataatatggtccatcatcaaatgcccgcatcgtatcaacctgccgattaaacgcgtagtcagtaccagactcgacaaaataattgaaatcatgaacggtcttggtaagtaccgtaccatcaacttccataactcgtgctaagtcgtttagagtagtggccttcacaactaaatcggtgagattattaatcggcgtatattgacttgctaacatctgttgatactgagtttcatcaaaaaccaagtatggatggacatttgtccgcggtactcgccacattccatgatcataaatgtgaccgtgccggttgacttcactctcatcaaaataccgactaccgtcatcagccaccgtaataacgctaccatggttcacttccggccagcctaaaatcaagcgaccacgttcaccttgtggtacggcaatcgaaagaccatgtaaaaatccgagtgattcataattttgcatgtgccaaaagtccgcgccaacttcttgggccatcttaataccagcacccttattaaacagcgtgcctaatggtgccaagtgctcagcaccaaggtagtcctggatgacttgttgattattttcaaaaccaccacatgctaggactacgccattggcagcccgaacattaactaaacgatgctgacgttcgatttggacaccgataattgtattcgtagtgggatcttgaatcagatgttgtgccggagcactaagccagacatcaatctgttgctgccgatctaacactttttgtcgaagaattttccacaaagctgcatcaaaaatgccatgatggacagttgtaaagtcataggattggactccatcaaattcaggaaactcatgaactgcactgtctaatgaaattggagaatcagcaactgtaaaatcatttttgacactcaccgggtcaacattgagatacttttgaacatagtcgcacatattcgccatgcccgctacgaaagtatcaaccatactatcgtctaattgcatgggtgccgttaagttttgataatattttttaccctcatcgaaactatctaccgttcctaagagttgggcagaataacgggtattgcctccttcatgaccattcggcgctgcatccgtgagcaataccttcgcatgtgcatccgccgcaaaccgcgctgctgtcgccccggcaccaccaaagccaataactaccgtatcatattgataatcccatttaacctgattcatttttttgagcatgctgaccaccctttcaaaatctatttaacgtattctaaagcacaattgaaattgatatttaaatcacaagcagaatcattttttaactacatttgtattatataaccgctttcatttttatagaaataacaatctgattatctgttattacaaatgagtaatgggttatacttgattttaataagattaagcattaaaggtggcgatttcacggaaaataaattgttagtatttttagaagctattcaacagcacaatagtatgacgaaagctgcacaaagtttattcatcagtcagccgtacattagctgcacaattaaaagtgcggaaactcattttgggacccccttaatcgaccgcggccatcatccacttgaattaacttatgctggagaaagattactgacttatttgcaaagtgacgctcgtctccatcagcgaatgaacactgagcttaaagaaatcagtcaaaataagtatcaaagtatgacgattgggattacaacaccaatggctaatgcttggtttagtcaaacactacctgctttttatcaacgttttccgaacattcgcactaaaatactagaaatcacaacatcaaaagcagaaacgttgctggctagtcatcagctagacttttttattggcaaaacaattcatcaaactaacgtcaagaccatccctttgcagacaatttctttgtctttagtcattccaaaaacagccggaatatatcagtccaatcaattttggcgaccgttcacccccaccattcttacaggaatgactggtgagcctgtcatccgtgcagtcggtgaagctcgctttcaagaactggttgaccattactttgccgataaaggcatccaaacgattccactcattgaagtcgataactctcgccttgcactaagcttgacacttcaaggacttggtagcattgttctagccactgcaatgttggcaaaactagccactgaaccagccaagtaccctatcaatgcgttcaaattaccaacaagcgagctcagccttgattttagtattgcctacttaccaagtcacgtgctagctaaaccgattgcttatctagtcgaacaagtttgtcaaacctttaatcctgcgattgatttttaacataaaacgcaaactgtcagcatctattaagctagatgcttgacagtttgcgttttactttcaaaatccatcaccgatagtgaatcatgttcaaccccatcaactgttgcattagttgctcattttctggcgatagtttgatttgttgctgccgcagacatttggagatgtctaaattcattctgtcgaatactcccagtactgaaccagttcgttgttccaatagttcctgataataagttgccagcagctgtcgtaacggttgctcattcgtggtatttagattagcaactaaatcactaattatgcccacagcaacacgtgcccgatcctgccccccgctgtaccatttcaccgtcatatctgttcgactccttttacgcaataacaactgccaccatggtcgctgaacaggtcttctgctcaaacctaataactcatccgttgagacagcaaatagtttgctcagtgctaccaacaactctaaatctggataacttttccctaactcccacttggaaatagtttgccgtgagacgtgtaaccgctccgccaccgtctgctgggaccattcatgctgttgtcgttgctcttttattttagtaccaatcacaattttcatcctacccgctcctctattaaaatactagactattgggtgcaccaattcattgcaacacacttaagcgctaccgcaacggttggttgcaaccactcaagatcaagtctcggtatgaaaatgttgatacaacgactttcctgaaactaacaattccacaacttgttgagggtcatcaaccgtcacaccttgtcgttgcaaataactgacaaattgcggtaaatagtcgctggccttcaacgcacattccagctgataagtttgggcattagtctttaaaatcaattgaaaataatccggattgaaatcaaatggtgaaagtcgtttgcgacaccgataactgatggtaacccgctgcagatctgtatagtggattagttggcgtcgtggacagttgaacacaatttggcgaaacttcgtcaatgtcgatgcagcatacgtatgcaattcaatggtagcaggctgaatcacccagtaactattgattcccactggaacgaccacaatcaatccaacaatataaagtgataaaaagagccaccacggctgataaccaaaaccagtaaacaatagacaaacaaatagccaaaataatccgagacccagaagtcgcccaaagcttagtcgtcgaccaacaatatatggttttggaaaaaaagcactaccacgcactaattcatccaaggatagattatacagatccgacagtgccagtaaattatcgattgacggaatcgcctttccgcgttcccacttagacaccgcctgagtcgtaacaaataacttggacgctaattgtgcctgtgtcaatccatactgacagcgacgcgttttcaataatgctgcgagtaacattggctcgcccccctttatgatttcagcttaatcctcaaccacgatcaaaccaatcaactcatggttgtttagtcacaatcatgtatggtagtcataatttgttgaacttccgtggctaaatcttgttgctcgccaattaagacttcgttagcaacgcccaacgtatcatgtggaagccaccaccgacgcatgtcttccacaccaaaatcacgatgacgcttttgatgacgcgccaaggtcgtggcaaagctcacttcaaaataataagtgaggacgcgtggaaacgattgactaagccgcgccaacatttccccataccaattacgtgctaagatgccttccacaatgactaccggcacacgtcccagcccataacacgcaatttgttcaatcagaccaattgaaatatttcccgggtaatcatgactcatcagcatgtcgcgacgaacgacatcctgggacactagcaacgtatgatggcccacacgtcgttgcaacgcctgcgctagcgtcgtcttgccactcccagaatttccccgaataatcaccaaagttgtttccatccacatgtcctccgctcattcctgtatcttaatcataccgcacagctaacaaaaaacgttagccaaattggctaacgttcgctgatactatttggctttactggcgttacgtcgggcatcatgtaaaatcttcaatgcgcgtttccgcgattttaagttggtcccccgtagacgcctgcgcgcacttgctaaatcttgtttttccatcatgggtgcctcctgataaatagtaattattaccatttaaattataatcaatcttatgcttacgtcaactattatgcagccagctgacattgacagatacaattagctcccaataattaaattatcatttattagactaacggcaatgacaatgttacccttaaattgtcaacgacattatataagtatattgaaggagtggggatctttgaaaccaaacaatgttaataatcagaataaacgtcaccaatcgcgatgggtaatcacgagcgcaaccgccatgatactgacaacgttaacgattgccagtcaggcggcggctgccgacgatacagtcacgaccacaaccaacgaaccgaccaacagtcagttgaatacgaatactcaagttaacgctactcaggtcaatttgaaagcggatacttctacatcagtatcgacgataaaatccgaccagccagcgaccgcagctaagtcacctaccacatcaaccggaagtccctctgagcactcgtcgtcagtgaatcccaaccagcaacaacaatcaacaaatccagcatcacaatctcaagcaaccaccacgtcagaatcaacaccaaccacagatattgagcacccaactcaaaccgcaccagctcaaacaacctccgcatcaactactgaaccaaccaccgaatcaaacactgaatcagctactgatagtcaggctaaagcaacgacaaccaatgatcaagcttccaagcagccaagccagcaaaccgcgtcgtccaactcaactaccatcggggtgaatactcagtccacgactagctcagcgttaaccgatgataaaattgttaccagtgcaaaccaggaaaagctggctttgaaaactaaccaaccggtcgttcgcgccactagccgcaccgcgcaagaaaatattaacgattggatgccgaatacgttattacaacaagaggtactcagtcaactgcgcaaacagaacccagatcgtacctggaactcagctgcagacatcactaaggcagatatgctactactgaccacctactatggcaaggacacttacatcgacggcaagacttcctactcattagaaggactacaatatgccactaaccttacgacagtctggctcaacaacaacttgaacgcaccgtctggcagctactatagtgatgtcactgatatttcaccattagccaacttacaaaaactccaagtggtcaatattcagcaaaaccggatcacggacatttcaccgctcgcaaacttaaagaatctaacggaggtcgatgccgcctataaccacatttcagatttctcaccgcttaaaggattcaagaatcttaaaggcacattcagtaaccaatttatcacattaccacccgcctatattagtgcagataataatattgcgacgctggcgattgattgctatttgcaggatggcactaaggttcaactgaaacccaatggcggcgtcggggaaactgttttctacaaaaacggtcagctttacgttcgctggtactttaacggtgcgggcggtggtaattacgacagcaacggtcatatctactacacgaatatgaagccccagcaacccggactaacaggtccgacctttaacggtaccacggttattcccatggacgattattatttcatgaccgccgcttctgacggtaacaactttgtcgtcgtccgcccgtatgtcttagctgccactgctgcgcccatcacggtcaaatacgtcgacgcgcttaccggtgaatccttagtcaccactgacctcaccttaaacggcatcgtcggtcagccttacacgactcagcgcattgatgacgagctaccaaattatgactttacgaacattgtcggcaatgccagtggtgtcttcacggcggatgcccagaccgtcacttattactatactcgtaaggacgccggcgacattacgattcacatggtcgatactaacggcaacttagtctacgagccgcaaattctacctggaaaacacaatctcggtaacgcctacaatttagatgcgccaacctttgaccattttaaattacagcaaactatcggcaatgcggccggcgttttcacgactgatccgcaaagcatcacgtttgtctatgtccgcttagacgccggtaacattacggtgaaatatcaagataagcagggataccaattaaagcccgataagacaatttctggctcccaatcactcggccaagcctatacgactgaaccactagacattgaaaattacaccctgatgacaacgccggcaaacgccacgggcactttcacagaccaggaacagacggtcatttacgtctatgtgcgccgcgatgctggccagatcgttgttaagtatcaagatagtgccggtaaccaacttgcccccgacaagcttttagacggtaaagaacagctaggagcaacctatcaaacggaagccatttcaattcctaacttttacctagtcgccacacctgcgaacgccaccgggaccttttcaaccgatacgcaaactgttatttaccagtatgcacgctcgaatgccggtcatatcacggtgaagtatcaagacgctaacggcacgaccttagctcccgacgacgtcctaactggtgacggtcagctcggtcgcccctaccagactagcgccaaggcgattgaaaactaccgcttaattcaaacgccggcgaacgctactggacaattcagcgaccaagcgcaaaccgtcatctacatctacgctcgtgaagatgcgggcgatatcacggttcagtatttagacgaaaacggccagcagttagccgccgatagcgtattaagcggtcaaggtcaattaggacagccctatgaaacgtcaccgctgaacattaacggctatacggtaaaatcgacacagggtaacacgactgggacctatactttacagccgcaacgcgtcgtttacatttacgaacggacggctggacagccggtcactgccaagtatcaggaccaagatggtaagtctatccatcttgacgttgttcacagcgggtatttaggcgatagctactcgactgaacagcttgttatcgatggctatacctttaaaactgttcaaggtgacgtcaatggaacgttcgggacttccgcgaagactgtgacatacgtctacgaacggacggctgggctacccgtcactgtcaagtatctggatgagcatggtaagtctatccatcctgacgttgttctcagtggttatttgggtgacaactactcgaccgaacagcttgctatcggtggttacaccttcaaggctgtgcaaggtgacgttagtgggacgttcgggacttccgctaagactgtgacctacgtctacgaacggacagctgggctacccgtcactgccaagtatctggatgagcatggtaagtctatccatcctgacgttgttcacagtgggtatttgggtgatggctattcgactgaacagcttattatcgatggttacacctttaaagccgttcaaggtgacgtcagtgggacgtttgggacttccgcgaagactgttacctacgtctacactgaaaacacccccacgattccagatacccaagggaccgttacggtgcattacgtgaccaaggatggcattaaactgaacgaaccaatcgtgctgagcggcaagacaggaaccacttatcaaaccgtgcccctgacattcactgatcatgaactcgttggtcagccggaaaatgctacgggtctcttcaccgctgataacgtggacgtcacgtacgtctatcaggcaactgacacgactggtaccgacgatattattgatcccgaagaaccagaacaaccaactaagccaattaagcccgtcgagccaaccacacccgggacgcctaacgaaccaggaacaaccgtaacgcagccggatcgtattaaaccgactcaaccagcggtggctgtgaaaccaacgcttaaacccgcggccgcccaggtaagtttggtcaaaacaacgagtcccgtcactgaacactcagcccagttaccacaaaccgacgaacagactggcaaattagcggtcatcctaggactgttattatccgtcgtcacgttcgggttctatggtaaacatcggcaatcataacgtcatcagatctaacgaaaacgacacttcgaaaaatgaagtgtcgttttttctggtcaaaggtgcctataataaaattaatcattataattccgatgaaggaagtcctaatcgatgaaagtttatctcattcgtcactccgaaccaacttatcaacaggtcactacggctggattaactggtttcggccgtgaactcggcggcttaaccgaccgcggtattatgctggcacaacaatgcgcccagcagccgttatttgcacaagtccaattaattctgtcatcaccctacacgcgcgccttgcaaacggcactggaaatcgtgcgttttaatgatatcccactaaaggtcgaacttggattacacgagtggctacccgataacacgggtagtcggactgataccgatgaacaagcggccacggcctacaagctctatcgacaacacgccggcaagcgcaccatcgctagttcccttccttacgaaacggcagctgaaatgaaggcccgagttttggcaactttgaataagtatgccgtatcttacgattgcatcgcctgcgtcacgcacggcgaggtcatgcggcagtttggcgatcagaaagacgtgggttattgtggtgtgcgtgttattgcggttgattagtagggtagagaaacattatttcatttagtatggtgaaccagattatgagatagtaacttggcacttttgcttggcttgcgaattggtgtttttcaaaggtacttctacagttgttattaaaacaattcagatagagccgtaaatcaacataattatttatgaccttgataattatactgatattaaacaaaatatggcataattattgattaggactctccggatgcttgaagccaactttcaaactgtgtttaagatgattattttatctcattttactcacactaagtgtcttacatctaatcatagccattagtttcaataaaatgaattagctaggaaattctttactattttaatgactaattttggggcttgctcattggcagcgataaggttatcaatcaacaatagcatgttacccaccaatacctgttcttttagtttaggaatatataacttaaagcgggcatattcttttgagttgattccaggttggccagatcgttgcgacatcacttttacaaatctattaaaagatgttgttaaggtattttgaaaaacaaattctgaatctatgtcttctctaacagacatttttattaaaaaaccggcgtaataaacaatactgtctgcagttctgtaggaataaattatatcacaaaaatggttacgttgtcaccatttattttttctttttcattacaactatcttacacctagcctatctatggattgtaccactgtggcgactgtgcttctgatgttgacgcttctttttatccagttcgtattctaattctttttgtgctttcttttgtctgttaagttcgtggtcttgtccattctcgtaaagtaagctcattaaggtatctgacaataatttgttcatatagtttgctggggtattttcgttataattaacggctcgataatcaggcatattctcttttcggaaatcatcattcttttgattatgttgctttactgcctgcttagcctgttcaagttgcttagcagaaatctttttatcttgtcctgcttccccaatgaataactgttgtgtccccctattcttcaatacacgtaacaaattagcgttttgaatctcatcagatttaacctgtccgcttagataagcaagtccctgggcatgttcctgggtcgtgaattgaacaggcggattatttctcaactgatctaaatcacgcttttctagtgatttaagttcaggattataataaacaactgctgtatataggcgttctttttcagtcattttgacttgatcaaggctcatatcagggaaagtcttacttaatacgttgttatattgcgtatcaaccacttgtttagtctcatttattgctgaaagttctttgatattcttctttaaaacagcttgttgtttctcatcaaagtcacttaacagcgtaccctttgtacgcttaatatctgctagttggtaacctttattagccaaaatatcactaatagtttccttagctcgctgttcttgtttttcaagcattaaccaactagcaaatgggcgctttgtaaacgtcagaacctgttgattgataatgtttgttcttatcatggctaaacggtcttttagttcatctcctgtaaataccctttgttcgctgtccgtctccttaactaactcccgtttttctgccattgttatttgctcaaaatcaacgtcaggataaagttttgaaacggttcgattaacgactttatccaataattgattggcttctgatagtgacttttcttgttgtgtaattgtaactaattgtttagtcacatcttcccctactgcttgcttaaccatggcactatttttccaattaaacagcatacgttgtttctcatctaggttctctaagctaacaaatgtttttagtcgattacttaactgtgcaaccagtcgtttttcatcaaatgaataatggcgctgtaaggtttgcatacggcgttcattatggattttttcattagcattttttgcttctgcttttgcttgtcgttgttgcttaacattttgattaaattcttggcgtttttctttctgtgaattgataccctcatgttgcgttgccacttcatcaattccttgttcttcatatgatttttcactaatacggtctggtaaatttttagcttctaaaacttgattaacagcggtagcccaattgtgacgccattcagttattttttcttttttatcccaatcagttagccatatttttctatttcttgcatacccactttttgtatatgttttattccctttttcatctaatatatattcttttctacttttaattccccatgttccgtcaggattaaatgggcgattggttaacatcacatgtgcatgcggattgtctgggtgatcgcgatgaattgctacgtcagctaccataccttgatcgacaaaattttcttgcacatattttgtcagtaattctttctgttcggattcacttaattctaccggtaaagccacgttaaattcttttgcataccgtgagtttgatttacgatctttcttctcaacttcattccataatttttgcctatcttttgcccaatcaggggcattttttggtgttaaaataaatgcttctggtttaacatctcttgcataataataggtattaccctctttatcagaaaacaacttatcgccactgcgataactcgcactagcaaccgcactacgcatttttcctgcgcttatattttgaaaactcatatggaaaattgccatgctgttgtctcctttcttttagggttttgttttttgtttttgttgccgccataggcggcttctgatacaggtttaagtgttttagcacaactcaaatttatttggagtgtaagtgcgcattgacctcgtttcactcggtctgatgattcccctaaatttacttatagtgtatgccttccgctttgctatttcaactttcatcctttgacttaacattctctgtatgatatagtgtcggtgattatttttaatatgattggagggatcgttatgtctcaaagcaacttagaaaaacaagaagctaaattaaaacagcttaatcaaaagattaaagctgaaaaaaataagattgaacaaaacctcggtaagcaaatcattagatcggccaacttagattatgcaacactgaccactccacagattaaaatgattgctaaaaaagttgccgcctttttaaatcaagctcaaaataaccaataatagttaggtggtaatgactatgcctaatcaatatgaaaaattagttgagcaacaagcgcgtttaaaacaaaaaattgagcgagaagattttaaattacggcaatctaaatactatgaaagccgccaagcacgcaaagcccattctcgccgattaattcaaaaaggggctttgctcgaaaaatactttcaagctgataacctttcggtcgaacaaaccgaagatcttttaaaaatatttgctaattatgttaatgctcataaaccgaataaattcaaaaacgatcagcctaataactaggcgatcgtttttattttctgaatcattcatgggatttctaatttttaaatctgaattatttttaacaaaggaatttaattgtttttgaacggctgcttcaaaggtgattttggggtttattcaaggaaaatctcgcaaattatttttaattacctggtcatgctctcttctgtaaactgatacaaatttttggctattatcgcagatcacgacgttatcagctttgaatgcaactgcttctaaattatgatttgattgattatagcgttttttaacaacttcatctggtaccccgtgcccaccctttttgacccgctcatgaacccaattaattgcgactttttcgttttttaacgccacgtataaaagtgttacttcaaaaccattttggtgagcccgctcgattaaatttaattgtgcctttccttggccagccaaggttgtttcaacatgaatactctgcccagtatctaaagccgcgtggagttgttttatttcttcgcgcattgccctaaagttatcacgctctttataccaatcgccacccattttttgtaggatttcatcggcatttaatcgtttggagtgagtaaataattcgggtctcgcacgatataaagtgcttttaccagcgccgtttatcccagccacgatgatgtatctctttaactcactcatgttaaatcacaaaatgattttcgttgataatttgctcttggcgtttatctaagaggtaagtgtgtaacgcgtcaaacagcttgcgtttatcaggatctgcattatgtgccgcttgttcccaaatgtcttgaatattgactgcccaggggtcagccaacaattgatcaattgtttcgatttctttgctgggtttggtcatttaaaaagctcctatcccatttttctagttcagctgtcgccaattcggccactcaaggtgcctatttttacttctaagcggttttaaagcaattttaatagattatgcatgtaacacttaaagcggcttaaatgagcttatatgccgtttgattttaaaaccactcattgtcagcgttctgctcttcggggtgtttagcagcatattctctagccgcttgtttattccaccaaacgccaaataggttttgcatggtgccgtacaagtagttttccacgttcttgatgtgcttttcattgcttcttagggcgttaaagtagcgtctcaaggctttagaacctgtttaaaatcttcttaggagtaataccagaaacgctaagataaccatttgacgacttgaattgagtttacgctcacagttcttccaaagtcgtcaacatttatccaaccaactgaaggaacgttcaacgatccagcgttgtggcagtacttcgaatttatgaagctcattgcgtttagccaccaggacggtggcgtttaaattagtgtaaacatcagcggcaaaattcgatccagtgtagccaccatcgacaagaaccgatttaacttgctgtaaatgcccagaatttagagctaacatggcactggctccattacggtcggaaacattggccgtggtgatgtgaattgcttgtggtaagccgttaatatcaaccgctaggtggcgtttgatgccggatatgcgtttaccaccgtcgtagccgcgatgctcagcagtatcggtatttttaacgctttgtgcgtcaatgattatgaaagatgttctagccgagcgtgactgttttttccgtagggtaaagacaatttttttaaacactgatctaagattgatagttcatcaataatctgttcctcagaccatacgcgataatagtaatagaccaattgccagcgaggaaaatcaactggtaactcgcgccattgacagccagttcttaaaacatagacaactgcacagaacaactcataaagatcatactttcgaggcctcgttgaacgccgtgcagcttctaagtcgggacgaatgagttcaaattgttggcgggaaatattgcttgggtagttcatgactaatcaccttttttgaactatcataccaaattagctagattttaaacaggttcttagtcccttctccacctccaaaaagcttatcaattaactgattattattaagcaatgcttcgggcacttgatacccggacgctagtaccactaaccactgaaaaaacgttgtcataaccaaacccctcactttcgatttacagttagcttacctactgctcatcaaaagcgagcaacactactcaactgataatggccgaatattcccggcttaaaacccgcctaggcggagtagcttgaatcgtgattatgcgtctcacgtgaggagttagttctaaccggtttggaggcgacgggacgactaataactaaataacaccctaatctagcccagttaacacccagcaggcctgcccagtccccaaccaagaaacccgtgtccagaactatagtaacgtaatggcattttagaacactaaattctaacccgtatctagcaaattcaattgggcattgcgatgatgatcttggcgagcatcaaggctcaattgttgtagcgccactaattcttctgagggttctaataaccgagcaaccgttatccaatagtttaatcgctgttggcgttgtaacctcatcgcatgttgtaacaagctactacgagtcgcaaacttcgttgcttgccgaccgctacctttttcacgataaactaagccttgatcaattagatctttcagggccttggttagactacctaagcaaatatttaattcttgggaaatgtgccgtaaagacgttttggtaaaccaattattgtcctggaaaattctttggttaaagtaagccataagatctgcttgccattcatggacatgactattaacgcgttctgaacgtggcttcgcatacttgtaccaggtcgtttgcgaacgctgcaaataaactcgcctgtcagcatcgggaacccaagtttctagcaacgcattcacatattcacgactggccgcatggaactgacctgaataagcatcattaattactttttgaacgtgctgtgtcgccagcgggtgggtaagattactgttaaactcgtccaaaatgtcaaaacactgggcttgtaacacgtttgaagaataacaagctaaggccagcgtgaagattgtattgtgccgaccatagcccacgttttgatcaatgtccgtttggttaattaaggcttgaaaccacggttggtcaacctggcgactagtccgccgagcataaaaagaccgttgagtagtttggggcttaatttggtgctgatcattcgcaaaattaatactccaagtcattaaagcttgaaagtcaaccgtcattttgggctcaaagtattcaatattgtccggccgcggaactctgaaaacaccaaagctgttgcaggtcacatcaaccgccggcaatttttgcgcgtagtattgctttaacgacttagcaatggctttagcagccctgacggctggcaattgaccattggcatgacgacggacgaaaaccggcctatcaaagacgtagtagatatgatagcccttggtagtcgccaaaattaaggttggaagaaactgtacgtccaacatcgccgtgtcccaaacctcggcaaactttgcttggcgctcctcagcgtcacggtagtcaacatcaaccactaacgtattgatctgacttaaattttgttccttagtgccttttacataatgcttagccgcatcagtataggtgaggtagttaaaaacattgggcgtccaatgcgtgctggtcgcatagttatcatagactgcttctttggaggtataaatcgtcccccagcttttcgccatttggcctttactacgatacatggcaatcgcaccttgcttattttgttgccccgaaaccgatttttccaacttcaagacgttactatgccgggctttagtttcccgtaacccttgatgcaaaatcaaatcaatcgcttgttgtgccgtttccgtcgctgacatactgctcacctcctacaaaaaaagaacgccgtagcgttcttagtcatcatttttatgtattaaaattaaacgttcaaacactagatttttaagcaatcgctccagttaacgtggctacttggtatttaaaccccaacttggctcttagggcggtcaaattcatcaaactgcattcttgccaaacgtaactggcacgagtacaattaactcattctttggtagttctatgagttcccgtgattagcctcacggggattttttgtttatttaatttttgattgggattagcttaacagttttcaataaacatgaagtacttctcccttttagccttaaccaaacaaaaagcagattaagccgcccactggggtaacttaatctgctttaactaaacctatgtatgcgtttaactcgacttttcgactggcataatcctaataggtttagtataatattcctatcaggcaactagtattgactacttttagtagttcatatcctagctagccatctataaaagacgagcgttaaaggcgatcaagtagccttggtacttgatttgctgttttgaaggttacttccaatagccttcaaaacaacgctttttttatttatctttatatttaatgatactgtaggaatgaacaaaagtaaagtcaaatcgactaaatatatttttgacaattcgcaatatatttagtattcttaatatattgaatatatctagtatatttaaattactgaatatatcaaatatacttaggaggtttcttaaattgaaaaagggccgtgttgtagtattaacaaacttaaaaggcggagtcggtaaaacaacagatacagatctattagcgatagtagccagtaagccatcattattcaatcagaaagttcttttaatcgatgtcgacttacaagcgaatactactaataacatcaaaagaacctttaacgtaaatcaatttccacaatcatttgtaaaagctgctcaaactggaactttaaaaaatgcaattatgcctttaactgaaaacttagacataattgcagggtcaattgccgaacacgaattagtggactcgataattgataattctaaaaacaaacgtgaacggtatttttatttcaaaaaaatggtcgatgaaatccgtccaaagtatgattacatttttttcgatgtagctccgtctaccgattcagtagtggacgcaataataatggttactgattatattattgctgtacaagaagtaaaaagaatggcaatggaaggcacaagtaatttcattagcaattatttacaacccatgttgaataacttcccaaacgaagcaaagtttcaagtagctggcatattacctgcattactttcctccagaaaaaagacacaacttttaaattacaaaaaaactgttgcgcgttacggtgaagataatgtttttcacactattgttaaaaatcacgaccgacttgaagcatttggagaaaatggcttttcattaaacgattacaatgacagaaaaatgtttgctttatttgcagatttgtttaccgaattagaattgagaattgaatcatttgaaaaaactggagatgttaaagactttcgatatgaatcacattattttgattcaatgactaatactacattaccagctgggaaggagatacaattagatgggattgctgaatagagataatatcgattcgaaacctaaaattgatgttagaaacgaaccaacgaaaatagatgacgacgccaaaatcacttatggcgaaaaaggttttaaggccaaggatcgaaaacctgtacaggttgatccaccagtattagaactcattcaaaacctaagttacgctaaagatatgccaatgtataaagttgtagatgttgcaatgaatgcttatttagcaacattaactgcttcggaaagagcaatctatgatatgaggcggaaaaaataaatatattaaatatattaaatgtactaaatatattaaatgcactaaatatattaaatgcactaagtatatttaatatattttaaagtttataaaaataaaattaagccattaaaaatgtcctattccaaagtatactaaatatatcaaatatatttagtatacttttatttaatttctattttaccctccttacagttgtactgtgttcatttggcccctccatagacaatttatgtatttattatatcacttatcatgaacatacgttccctttatgtggtaaaataaacgtaaattattgagaaggtgagcatatgttttttaatcaagaaccgcatggcgtgttctttttaattgataacaagtccttttatagcagctgtgaagccgttgcccgtggtcttaatcctttaaaagtcccactagtcgttcttagtgaagctgaaaacaccaatggtgggctcatcttagccactccacccgaggctaagcagttatttcatcttaaagccaatgtctcacgcaaacgtgacttgcccaatgaccctagactctgggtcgtgccgccgcgcatgaatctctatattcaacgcaatttgcaaattaatcagatttttcagcaatttgcgagtgaaaaagaggtttggccctattcaattgatgaaagtattttggatatgacccattcatggcggctttttggcaattctattcgtgaagtggcgcggttaattcaaaaaacgatccgccaacagctcggtttatacaccactgtgggtattggtgacaatccggtgcaggccaaactagccctagataactacgctaaacacaatcatgaattgattggtgaaatccattatgaaaccgtgccggataaggtttggtcaattaacgaattaacggacgtttggggcattggcccccgtatggctaaacgtttgaaccgccttcaaattcacaatatgtatgagttagcccatactaacccttatttactcaaacagaatcttgggttgattgggagccaattgtttgccaccgcctggggcgttgaccggacccggttaactgaaccaatcaaaactaaggaagctagtcttggtaactcacaagttctcccgcgtgactacttgacacaaaacgagattgaaacggtcattaaagagattggtgaacaagttgcggcgcggcttcgtcaccaccataaactagcagggtgtttatcactaagcattggtttttcttatgctgcggctgaaaccgatggccgcagtggctttcaccaggctttgaaaattgaaccgactaatgataaccaagctttaacgcaacaattattgtggctatttcgtaagaactgggacggccaagccgtccgtaatattggcatttatagtagtaagctcagtcctgacgccggtcagcaacttaatttattcgcatccccgcttaaccaaattcagcacagcaagctgaaccaagttattgatgaaattcaccgacgctttggcttcaccaaactcgtctatgccaccagtttattgcccggtggtaccgctattgaacgggctgctttggtcgggggtcataatggaggaaatagttatgaataaagatttagatattatcacgagtcgcttagccttgttgtttaaaccgactagtcgaacccgttattggctagtaattgccaatgacccgtacgatcacacttacaacgtattcttcaacagtcagcgagctaatgagcgactacggtcaatacctttacacaaactcgctaattataatctcaatgacttagaaaacttactaaaggcgttgcgacaacagactaaattaacgattgaatttattggctttacgggtcaagtttggccgcaaagtcaaaaaattattcaaaagaggcgacaggcacttgaatgaaaagcgttttgacctcaacattgttaaccgcttctttgagcacgattaccacgatcgtggcctaatgaaatggcaaggcttttacttatctgatcacactgccgctttaaaccaacagaagatccaagataaacaacaatatccacccagaccacaacagtctttaagtatcattggccaaatcttgtcaacagcttacacccagaaccaaccagtcaacttacaattaaacaccgttgatcataataatcaacactttgcgaccatcacaaccccaatactgggctataatggggctactattgtgattgccaaccaccaatttatcaatattaatgatattcagcacatcgaattagtgcgctcaactaactggactggcaatcaataaagaccaccaaggatctaatgacgaaccttggtggtctttatttgaataagtgcttgtgctagtaattaccgtttagatattggccactaaagacgcaaagaaaaacatatataggacaaaaatagcaatcgaaataataaattggactattcctgctcggttccaagtcgcttgcacagccttgaatgtctcgacatcttgataatcacctttttgccaggcccattcattccccttaaaaccaaccacaaaaacccaaacgatattaaaaattggaattaacgttaataacggcaaataggttttattgccaattccccaaaaaatactgtacataaatgcgccccaattccaccctttgaccgcttgtggcacttctttaccattttctttcatcattacgttcccccttaatattagcttaccaaacctaagctggcttgtatactaacctattatacgttatcgcgatattgtattacgtcgaacaggtttaactgggcctagattcaagccccgacgtcttgcttcacgattagccaactgcaagctattattcaccttagtaatttgttcagaatttaccgtcttttgtgagatgctcattcacaaaccgctgcgtcttatcagtaagtttcgttgctaacttcggtccaactacgttttcaatcgttatctcgttctcgttcaaagatctggtcaatagatctttcaggtcgtctttctcaacataatcttctgcgccaccttcgtaaaaggtatcaccctccttcgttcgataggctgaatattcatgtcccacttcgtcatagtcgtagaattgagcaaactcagccttagacgcaatctctttaacgaaaggggcctgactaggcttaattttttctattactgtcggtgtctcaatcaatccttcgttcatttcctgtaaactactaaccggccgatatttttcttccgttttatttagacttttatccatagcactatcagaatacttcaccacgtacccgctctgataaattagatggctaatgattttctcttgcacttttggctgatctaaatcccccacaatgtctgtatgtccatacgggccattgcgatcatattgggttaattgccaatccacacctgttctagcgctttttgtcaaagtaatacgagtatgattatctaggtcttttacttcgaagccacggcctctgctacgttcaaatacacctttccaataatcctttttctgctgaacaatttgtccactcgcagccaaacccatttcaggttgccatactggaaattcagggacaacctcttgtcttaactcttcattttgtggtcgccccatacgctgctcacgccgcaagtcctgcaccagcgcatcactaatttcgattgtcttatggtagattgtaaaattaatccgaacagcgttcggattaattttacaatctaccacaatgaaaggattttataaaggtatagggccttaagtaattgtgtaagcgatgaaagaatgactttggtcaaagttgaagttttacttgagattaaaatcgatggtctacctgaatttgtcggtaaatggagggatttcgtggtaaacttcagatggagaagcttgccaataaatgaaaaaggaaacgctcatgattacaataaaagatattgcgcgtcgggctggtgtctcagtctcaaccgcctcacgtgcgctaaataataattcaagaattagccttaaaacgcgtgaacgaatccaaaaactcgccaaggatcttgattatctgccaaattataccgctaagaacctgactcgcggtgaagcaaacgtcgtcggagttatttttccaacggtggaaagttcctcaccggagaatccgttctatattgatatgctccgaggcatcaatcagtcgctagtcgcccgacactatgttttatcaattgcgattgggagccgagttgaagaggtccttgctaacgtgacggccatggttcaacaggcaaaggtcaaacggttcgttctactatatacggatgagaatgatccggtcgttgactatttgcgtcgcgaaaatttggactttgtggttattggtcagccagttggagatttgccggatcgatacgtcgataacgacaatgttcaggctgggcaagatgccacaatggcaattcttcaaaatggcggggttcgaaacccactatttgttgaatccgaatatgagtggcaatacgagcgaaatcgccgaatgggctacgaaaaggcgatggcggaagtccaattagaaccgctagtatttagattaccaaaacgcgtttctgaaacagcagtcgaggtatttttgaatcagcaccaagaggtcgatgcggtaattgcaaccgacgatgttggcttgctgcggtttaatcgggtttggagcaaaattcgacacacaaagaaaattccgatgatgagtttcaataagagtgagctactagcgttgattgaccaagatgtccgcatggttgatatgcggccggaaatgctgggcagtcgcgcggtagaattgttatttaccgatcgaaatgttcaaaaattaattgtgcagtacgagttgtgagcaacaactcttttttattttatttttgtgcaaacggttgcacaaattatcaaagcggtttataattcattttgttaagaaaaatgggttcacataccccaaataaacagggagtgacaaatcatggaaaatgattcagcacaaggcaacacggctacaacgccaaaaaccaagccaatgccaaaattgtctatcgcgacaatttggatgattagtttcggattcttcggtgttcaaatggctttctctttacaatcttcacaaatggggcggatcttccaaactttgggagctgatccaaccaaattaggtttcttctttattcttcctccactagcaggtttagtggttcaaccattagttggctattattcagataaaacgtggatgcctaaaattggtcgtcgattaccttaccttttgatgggatcgttagtcgccgtcatcgttatgttcttactaccaaactctggtagcttaggatttggttatggatcacttgcagcactttggttcggtgccatcacaattctcttcatggatttatcgtctaacgttgccatgcaaccattcaagatgatggtcggggacatggtgaatgatgagcaaaaaggatttgcttactcaatccaaagtttcttatcaaatagtggttcagtgctagctgcaattttcccatacctcttaactggtttgggtgttgctaacattgcgccaaagggtgtcattccgaactcagttattttctcattctatacaggtgccgttatcttagttatctgtagtgccttcactattttgagagttaaagaatatacacccgcagaatataacgcctatcacggtattactgaagcagatgttcaagaaaaagttggtttatttacacttttgaaacgtgctcctaaagtattctggacgttaactcttgttcaattcttctgctggatggccttccaatacctttggacttatggtgcaggtgccgtcgccaagaacgtttggcgcgcaacagatcctgcaagtgctggctatcaagccggtgccaactggttcggtgttctatccgcaatttacgctttagctgccgttgtttggtcattagttcttgctaagatgccaaatgacaagcacaagccaatgtacgcaactagtttagtattaggtgccgttgggtttgcctcaattttcgttgttcataatcaatgggtgctcatcctctcattctgcttgattggtatttcatgggccgcaatgatgatgttcccattcaccattttgaccaacgcactttcaggtgccaacatgggctcgtaccttggtctattcaacggaagtatctgtttaccacaaatcgttgcttcagtattgagtttcgctttgttcccattgatgggctcatcaatgccagggatggttctcttagccggtatcttgatgttagtcggtgccttctcagtaagcagtattaaagaagtattcgcataaaaattaaaggagtctgaatgatgaaacgaacatttgacgtatcaccgtggcacattgtgaccactaaacttaatccagacgataaacgtcttcaagaatcaatgaccagtcttgcaaatggtaacctcggcatgcgtggattctttgaggaaggttacagtggcgacacgcttcccggaatctacattggtggcgtttggtttccagataagacaaaggttggctggtggaaaaacggctatcctaagtactttggcaaagtgattaatgcaatcaactttatcaaggttggcattaaaatcaacggtgaagttgttgatttggctaaggacaaggtgagtgacttcaaccttgatttagatatgcaacaggccgttctcgaacgggctttcactgttgaaaagggtggcgcaaaggttcagatttcatttgaacgatttgtcagtgctgcaactaaggaactcgttgttcaagggattatcttgaagaatgtgggttctaaagaagctaaggttgaattcagttcatccgttgatgctgatgtacaaaatgaagacgccaattacgatgaaaagttctgggacgttttgaaagttgctaagactgataatgaagccgaagttattgcggaaacaaagccaaacgactttggaacaccacaatttacggttggtgctttatcaacagttgtcacggactggaacagtgagtctgcagaccaaaccgatgtctcagcgacgaaccattttagcggaacactggctgctggtgagcaaacaattatccagaagcgcacagttgttgtgtcatcacgtgacttccctaaacaagctgatcttgaggctcgtttaacccaattaaataaagaaatttctgcaacatcatacagtgatttattcaacgaccacaaagctgtttgggcaaatcgctggaacgtttctgatgttaaaattgctggcgacgatgaagcgcaacaaggaattcgttttaacctattccagctcttctcaacgtactatggcgaggattctcgtttgaacatcggacctaaaggctttaccggtgaaaaatacggtggtgccacatactgggatacagaggcctttgcggttcccgtttaccttggtgttacggatccaaatgttaccaaaaacttgttgaagtatcgttaccaacaaattgacggtgccttccataatgctaaggaacagggccttaagggtgctttatacccaatggttacgtttgatgggattgaatctcataacgaatgggaaattacatttgaggaaattcaccgtaacggcgacattgcctacgcaatttacaactacacaaactacactggtgacaagtcatacgttcagcatgaaggcgccaaggtcttaacggagatttcacgtttctgggctgaccgggttcacttctcagaacggaatggcaagtacatgattcatggtgttactggccctgatgagtacgaaaataacgttgataacaactggtataccaacattttggcacaatggacgttgaaatatacgcttgaaattttgccagaggttgcaccagaagttgctaaagacttaaacgtcactgacgctgaaaagaaacagtggcaagacattgtggacagaatgtaccttcctgaagacaagaagttaggaattttcgttcaacacgatggcttcctagacaaggatatcaagccagtcagctcacttcctaaggatcaattgccacttaaccaaaactggtcatgggacaaaattcttcgttcaccatacatcaaacaagccgatgttcttcaaggaatctgggactttattgatgactttacacctgaacagaagaaagccaactttgatttctatgagccattaacggttcatgaatcaagtttgtcagcttcaatccatgccattttggcagctgatcttcattatgaagaaaaggcaaccgaattgtatgaacggacagctcgtctcgatttggataactacaataatgacacggtcgatggtttgcacatcacagctatgaccggtggctggttagccattgttcaaggattcgctggcatgcgagttcgcaacggtgagttacactatgcaccattcctacctaagaaatggcagtcataccagttccgtcaattgttccgcggtcgtttgattgaggtaacggttgatcagtctggtacgaagcttgacttgctcgatggcgacccaattacggttgacctcgatggtaagaaggaagagcttaaataggactaaaaaaagggcaagagtgggaaactgctcttcgccttttttattaaaagaaagtgggtgagactggtggaatcgactgttaaagattttggccatttagaaaatggtgagttagtcaaagaatttacgattacaaataaaaatggtgtgagcctccgcacaatcagttacggagcaacctggactggctactttgtgacaccagagaagaatatcattttaaattttgataacgtgcacgaatatgaaacgaatccctttcatttaggaaacaccattggtcgggtggcaggacggttgagcggccatacgtttaacgtcgctggattcagggtcaatttgaagccaaacgaaaataaaaatgtgctacacagtggtaacacgggcattgatcggctcaattggcatggcgagattattctagacgaccaatctgccaaaattcgatataccatgcaacagaaagcaatttttcctgggacgttggaaatggccatcacctattctttagatgaggataaccatgtttccgtacaatatgagggacgcagcaacgtggaaaccctatttaatccgatgacgcatgtttactttaatttggatggaccggacgcgccaatcaaggatgaattcttgaagatagttgcggataggcatatcgtggtaaatgaagaaaagattccaacgggtgaaatacaggtcgttgaaaataccccgtttgattttacaaaccttgttaagctgggcgatcaatgtgaaaaacttggcggcaacgaacagtttgatgatgcctttaaaaagccggatacatcgctaggcgtaacaccaagcttgttactagttgatagcgcaaagcagcatcaattagaaatgggcagtgatcgcaatggcgtcattatttttaacgtcaatcccgattgcattggcaaagatgcggattggcttgctgctcatccagataacggactggctgtggaattacaaacggtcccagatgcgattcaccacgacggatttggcgacattgttttacccgctaatcaaactaaaacttacacatcaacttattactattcggagggataaccatgaagtttgaagatattaagggatttgcatttgatttggacggcgtcattgctgatagtgcccgattgcacgctaaggcatggcaccaaacggcggatgaagttcattcagaatggacaccagaactagcggaagccttgaagggtgtcagccgcatggattcactggaaatgattttgaaggcgggtggccatgaaaatgactacaccgaggatgaaaaggtggctttggctaccgaaaagaacaccaagtatttgaagctggttgaatcattaacgccagatgacgtgctaccagggatgaaagccttcttagacgaattaaaagctagcggctataaaatgtccgtcgcttcagcctcaaagaacgcccctgcaattttgaagcagttgaaaattaccgactactttgaaggcgtggttgatccagccaaattgcatgccggaaaaccagatccagaaatcttcagtttggcggccggtgtgatggacttagcaccagaagttgttgccggtctagaagattcaggtgctggcattaagtcaattaatgctgcgggtgaactttcaatcgggattggtaatcaattgatggaagcggatgtgcgctttgcggatacgagtgaagtttcgttaaaaaatattaaagctaaattaggctaatcattgagccggcactgtttttagggctctctgtcaaatcctgttgatagatagttttacagaactagaagctaagcggcttctagttctgtttttgtatttggttttgttctcgtttgttgaagcttaatccgcgagattaaatgatggaaatttctaaatccaaacgcagtccgctgaatctgcttaatcatccgattaataccttcaattgggccgttagaatacttagattcactggcattcaagacaatttccagattacttttaaacgtttttagtgtttccttcatttgaaaacttaggttttcatttttgtagagatagtagacaatgccatctttgtcatgatttttaagacaggacatgataccttgcagcgcatcgtatgtgctcgaaatagtgtcatcagtgtcaagctccatttgtactcgcccttgttgagttaactgctgtcgtaaatgacgatcatagaaagtttggctgacttctagttcatcaaagtgcttcaaatatagtttccatgagaacttaagcagtcgatattcgatagatttcttgtcatattttttcattgtctgaactctagtctggttgaatgcccgcgtcatcatggcgataatgtggaatcgatcaacgacaatttctgcgtttggaaacatttccttaacgatatctttatagtaactattgagatccagagttacggtttgaacccgttttcgggtattgatatggaatctattaaagtactcaataatgctttttttacgcgcgttttataatcaagttagccaaatacttttagctaattgacaaaataaaaaacaccaagacaaatctctgttatcattgatgttcctacacaaacaatgaaagaggttattgtcttgatgcaagaacagaataccacagtcagaaaaaaaggtcagcacctaacttcgtttgaacgaggcagaattgctacgctgcacagccaaggctattccaatcgtgcaattgccagagcgcttaatgtttgtcatcaaacaatcaataatgaattgtgccgcggcgagatcgaccaagtaaaaaaagtgaatggtcaacgccaatattacgctgtatactcaccagaaacagcacaagctaagtacgaagctaatcgagcccactgtcatcgacctttgaaattcgtcggtgtcgctgattttatcgactattttacgactcatttgcgtcaagatggttggtcgcctgatgcagcagtaggacgggccaaacttgaaggcttatatcaacctgaggagatggtctcgaccaaaacgctataccactatattgatgcccagttacttgaagtccttaatcttgatctactcgaaaaaacgcgccaccgtgccaaacatcatcactcgatcaagcacaagcgtctggccggaaggagtattgatgaacggcctaaaagtatcgaccagcgccaagagtttggccatttcgaattggacaccgtggtgggcaagcgcaacggtcaagagagtgtgatcttaacgctgatcgagcgtcaatcccgctgccaaattctacgtttgatcgatggtcgtgatgccgattcagtcaactatgagctggccaagatctgtcaagaatacggatcaatcatgaagtcagttactgccgataatggcgctgagttctcggaagttggcgctgtacttaccggtgtcgctaacctttattatgcccatccatatcgttcctctgagcgtgggactaacgaagcgcataatcgaatgatccgccgcgatgtacccaagggtctatccatggatattttgggccctcatgatatccaagcagttgagtcaaagctaaacaatttaccgcgccggcaaactggctatcaaacacccaaagagcttttctccgctgcttccgccggttaagttaagtccataaaatatgaatattaatgaaaatactgatttaataggatttatcgtgtggctaatttgttcttgcaatttgggtaaaaaagaacaaggtgagaaaccaaaattagtttctcaccttgttctttgagcactcagattcctgtaccaaaccatcctataaccaacgatagtaacaataaagagtaagattgtaaatggtacttaaataaggctttgtgatcttgttcgtttggtagtaggaaagcttgtttttcaataggctgctcatgccaaataggttgttgtttccaaaaatgatatagctgttggggaagtgctatcgtgggtggaatagcaatcataaagccaatgattgctggtcggatttggatgatactatttccgaaagcaactatgtaccagagccacatgagcgaaccataaaagcaacctctagcaactgtaaactctagccagaagagtagttcgttttttagggagcttctacgatacgtttgaaggacttttttttgatctgtttcatcttttgacgggaatcgcttttttttagaaagaggccccaaaaatataactcgtctgatcttgtatagtccataatttttttcgaatcctaccaagaaatatgagtaaaacaaactcaactaataagatcaataatggtaacatcaattttgggcctccttaaaaaggtacacttatccagtcgctggtagttacttatcgtgaatgttagagttatactattgctgattttaaccaccgaaattttaatagttaattcagttggcgccaacgtggtatttattaatttgggccacaatagccgactacatctataaatgacatggtatcatactatttatagatgtaggttgctaatgaatcttttaatcgatggttatgttggtttttctcaaacagtccaactttaaccatgtaacaattaatgagatcatagcagcacttgaacctattaatcaacggccattgaaaactatcggacttattcggattaattttacaatctgccatatatctaagcttttttaatggtgagaaactttgccacttgcaatgctcgattaattacttaggtatacaaaatgattattgtcacgagactaaaataatcttaatgtttaaattttcttcacttcaacaaaagaccggtctgccaaaacccaaagattttaacagactgatctttatttacattagtacatcttgacttatcttgaaaaaactttaattgatcctagcaagttgttgtgacaaagcttccacttgtttagccaacttctccagattgtgactctggttgaaagcttttaagttcgcttgcacttgccgaacaccttcctggaccctttcttggccattaacagtcaaagatagccaaacaactcgtcgatcatttggattcacttgtgattgaattaaattatcttgaatcaatcgccaagtattcctggaaattagtgtgcgcgtgaccgtgaatgcatcagctaattcactagcagtagcttgcccatgttgttcaagatagactaatattccccactcacgcattgaaaattcagttttggccagtccttgcactaacatctggtatgcctgattctgaatagcttgcagggttgttaagctctcaaactggttcttaatttgctgatgatttagcatataatatcatcctattctttttgctgccgcttagtcattccgaggagtcctaacaaactactcatgactaatagtaataagcccctcagtgtcatatgtcgttggtcagtttcatcagttcaaggcaaccattgacctacaaaattagtagcctctgtttgaccaccctgaaccggcttagcagcatcgttgattggctcgggttaatagaaactctaaaatctgtcgataaactatttataattcttattataataaattgattcaaactcattatgaacgttagaaatattattaatatgcattgaaggttaattttacaatctacctaaaactaaatataatttttctaacttagttgttgcacttaaactactgcatactcatttttcagtcttacttaatctgcctcgatgataaattttcttttggattaagtattgatcctgatcttgagtaataaataacggagaactttcttctatgacattgctaaactccaaaccataccatgaaataggtgaggccgtaattttctgcaaatagatgcgcccgccaatcaatcttctatctaacgagcttaacttatcattggcaattaaatctgctggttgttcctttataataacaaacttaaagtcgccgactttccgttgtcgctctgttgaatacgtgggtatttgtggttctaaaataccttgttccactagatgatttacaatttgatgtaaatagacactaacggattgagatttcttaaaccctaagtacaattgaacgttaacaacattatgcgtctcaagtaaatcaactgtataattactttcataaggtgcattggtttcattgactgtaacaaaccaataaactttagctcttttgggttgtctgtcgagaatagaatacatggtactacgcttaatttggtaatcacccttaattttagtcatatacactaagttagtcgtgaacaaaggtattgtattgtctgcgcttaatttagagagttgatcacgatagtcaagaagtgaaacatactcgctttctttctcataatgttctcttcgtttatttccaaagtaccaaagccacataatataaagaatgcccaacatgattgttaacgtaacataaccgccatgaataaacttaaccaaacttgaaattagaaagattaactcaataaaaccaaaaaacaaggcaattataagtgctgttcccttagccaggtgtttctttaagaattcatgcaaaagcacagtagtcataagcatggtaatagtgatcgctaaaccatacgcggcctccattttttgtgaactaccaaagaaccagactacactaattgttattatacatagtatccagttaacagttgcaatataaatttgattttttatattacttggatgtctaataaccattctaggtaaaaattttaagccaattgcttcatcggctaaagtgtaagaacccgtaatcaacgcttgagaggcaataattgcagcgagtgtggctagcacaatgccaactaggcgccaagttccggggagcatttcataaaagggatttaagttcgataagttcctgtaagcagtatcacctgcatgtctaattatccaagcaccctgacctaagtaatttaaaaatagggtactatatactagtggccatgttacataaatattctgcttgccaacgtgacccatatcggaatataaagcctctgctcctgtggttgccaaaaagatacttccaagtataaagattcccactttgttaactggactgaatagtatcctaattgcataataaggagaaatagccttcaatatcattggataattgattagattaacgattccaaagacagccaaaaagccaaaccataaaatcatcactggtccaaaggatttcccaatcacacctgttccaaaacgttgaatcataaataatacgagtagaacaactgttgtgataatcaagacgttatgttgagaattactaaacaccacagggccaaggtgttgtttttttaatccctcaatggctgaagtcacagttactgcaggagttaatgttccatcggccaaaatggccgccccaccaatcaaggctggccaaattaaccattttgaattttttcgaaccaatgcatataaagcaaaaattccgccctcacgcttattatcggcttgcattgcaatgacaacatacttcaacgttgtaatgatcattaatgtccaaaaaatcaacgagatcgatccaatcacgtaattgggagaaatatttcccattttaccggcgtcaccaatcaatgcattcataacatacaatggtgaagtgccaatatcaccgtacacaattcctaaagtaacaagtgcccccgcaaaagaaacacgttctagttgcttattcatatttgcttgcccccaacgctaattattgaaatatagcactgcaaaatagtaagcctaaacacgaagaaaagcaactatgccatatacatcataatgaaatcactttaaagaagctcataatttacaatctaccttaacattaaatttctttcgataccttataaaggttgtccgtttaattcctgtattacgggcaacatcgacatcactcatgcctgcctgataaagtttaaaagcatgttgcaagcggggatcgtcttgggtgtattggggtttacgcccatgatatttaccctgctgcttagctaaggcaatcccttgttgctggcgctcaatgattcgcttacgttcactttcggcctgatacttatagagttcaataatcaagttggtcatcagttgacgtaaatttgggtcagcaatccctgtcatggacggcaaatttaacacatctagggtggcacccttattttgaatggagttcatgatcttagtcaaatcatggttgtttctgcctaagcgatctaattcagtgaccattacaatatcaccctcacgaatataggccagcattttttgcagctctggccgattagtgttagccccacttaatttatccgtaaataatttatcaacgtcttttaaagccgctaattgtcgatctaaatgttgctccttggaactcacacgcgcataaccgattttagccatttctagctctcctttttggacagttctaatgaacatctgtatttcctagtatagcacagaaacaaaaatggccactagggtatactctattgaacacaaaacgatacttgactttctaaatttatatagttacactgtataaatagaaactatatacagtgtaactatataacaaaaaaaggaggaacatatatgagtagaaatcctcatttacctttaaccgaaacaactttttacattctattagttttaaccactcctgcacatggatatgccattattcaagaaatagaaaagttgagtaatggatttgtaaaggtagcagctggaaccatgtatggagcgattgaaaatttacttaagcttaattggatagaagaaattccaaataacgaaaaaagaagaagagtttacaaaattaccgatataggagaagaagtcttaacactagaaatagaacgtttaagaagtctgattaaactatcttctgaatttggatattaggagggaaaaacatgaagaaatttagaattttcttatctttaaaaaaagaagaagaatggattaattctatacaagaagagggctataagttagtttctgttaattctgcagtccctatgtatacttttgaaaaattatctactaaagaaatgttcattccttatgtacgccttgattttagagaaaaaagtatgaagaaaacagactatgaagattatgtaacactattttctgatagtggttggaaactaataaaaggaagtcgttctggtggtgctcagtactttcagcaaaaacgtcctgacgtatcaagaggaatattttctgacaaagattctcaagaaagtgctaagagaagatatgttaaatatggttattcatacggatttttatttttattgtatttttatatttttagtagaaatacatcctggacccaaattataaacttcaagtcatggtatctaacaccaaatatctggaatttaaaaggtggcagtttttggtattcttttctttttgaaactccctttgctttactccgtgtattaccgttattcttctttttatttttaggtatctattacctcatacgttcacttataaatgacgattcaaaatttaaaagaaaataagaataaagaaagaacctcttctaaataagggttctttcctttattcgctatagttaaatagagcataccctgttggccttatataattccagatataaaaaaatacctgagtaatcagaaacaaaggtaattcttttattttccaatattatttgttaaatgattcttttggaaacatttttaatttttaatagttccatcagaaataatgaaactttctccataaactatttcatattgaccatcaccatataaataacatccatcatttaatgtaataaatgatctgccaaaactatctggataagtgatttcttcaaaaagtctcttaccatctaaatattcgtttttgattaaattataatgaggcaaaatctgtgattttgttattcccaaaccttttaaaaatctcttgtagtttgggtctaaagattctccttgtagttctggttgagcataaacttcttccgagcaattcattgaacctgcactaaaaccgataataatcttatttgcagtttttaactcattctttaaattaatttgttgaaaaaatatattttgtgttggaacatgtcctcctgcaagtatgacaacttctgcttcgcttattaactcacttttttcttttgcatttctattatctaatactttaaaattcttaaatttaaaacctgagttaaagaaacaagtcttcatttcttctgcaaatttatcagtcaagtcatacgaattagggtccgaacatatgaatagtgcattagccctctcaggtatatctttttgtaaattattcacaaattcgttactaggatttagtatttgctctttaactaacaatggattacttgtcaaaaaatacttcatgctctttttccccaattcttttaaataattagctattttcaacatcccttgactgtttatgttttctttaaaggccaatgaaagattttttgaattcatcatcataagatttgattttagctttataaaaattttcttcttagtttttgctcctatcctactattagcggtaatttaggatattgatcctttaactcatcatataaggtcttattaagtctatatatgcaatacttgtgcttgttgaagtcgtctctaagacaatgcattttacaaagatcgatatgttggtccaaaatattttcatcaacaaactgtttaatataactggtgaatgcaaagtataaagctacatagaccgaataactccagtctagataactagtgctgagaaaggccatctgccagcccattcatacctacttctgaataccctcgctcagcggcttttttaacaacgtcagaataaatattgtattgggcaaaactgatgtctgtttttaactttctagctagagttggaactaaatcatatttttcaaatgcacaccctcgataaatgaagttgctattatccttagcttttgaaatgattttttgtaacgtagccaatatttcattcctcttgtataattaaagttcgtagagaagttaaggcggtggctatttccgatcggaggtggtgcttatggtgttaaacctttaaagcccataaatcctaacgaaaggagtagcctaagtgtccgttgcggacgctttacaattaatgctggctttcggtacctttatcgtggctttaattgcattaattgttgagctgatcaaaagtcagcaaaaaaaataatccgtcttagcttttggcagggctaacggattatttaatctattattaaactttgccaccgtcttaagcggctctacacgggaagtcctgttccagcagggcttcctttttcttactcacattatagcatgactataactgactttcgactatttttaatcagcttttttagcagttttaatgtgagtaatcaatactaattttcttaattaaacggccaccacggaaatcgtttagtaatccgtctttctgcatgagtatcgtaagccacataatgattaccagcttgttcacgcatcattagggggatctgcgcacgagagaccagacgaatatttgcaacataggatcctttatgagcaacaagtgcccagtgctgtttagaactatattgtccggtataaaactttagccaactaccactaccaaaaggatcatcagctacaaacgcatcaactcgctgcggggttttaacagcagcaacatgtttatttttaccatcactatcaatgatagttgtcttttttctcttctctgggacctgattagggagtaccgcataaccatattgaactcttaaaaaaggattgaaacgatcaatccattcattttgcgtggcacgcccatatcctaatatacttaaccataaaaacagtagcacaataattcccaacacaattagcaagtagcgtttgtatttatttttatcccgcacatcttgactaattttattgaccatcaaatttccatcacctttaagtaaaatatctagaggaacagctaaaaattcacttaaatttactaatgtgtctaaatttggataacttaaattattttcccagcgtgatagcgtttgacgtgtcacatgtaatttatcagccaattgttgctgggttaagtgcagttcttttctttttttccgtaatacattagcaaattgcaatttaatagccctccttaacttttaagatagcagatatctcgcgaatgtaacgcaattaccatgttacattgcccgttttcccgtattgaacgaaagaacactgattccatctggcaatggcaaccagaaaaccacgtctgatattttctgtggtgagcttcattggagcagcgattacgtaagatagcgacctttcttgaagctaactcatttacaaatatcccatgatggttaagcatattccctaatgtgttaaaattaaattgtgagtatctttaaggattaaggagtgaattctttgaaaaaacacaaaaaattaattatctcactaatagtaactatgctagtgattatttctggaggaatatacataggatatcagtatggacctaactttaacttctacttggtcccaccaacccctaaaagagacgccatgctggcttttaataaaatatcgtccacagggatctatacagaaaatcaaacgcagaaaaataggatgacagagattcgcaatgacatttcaaataagcatacctacaaagaaatttatccactgttaaaacaagccttggcaattaagggtggtaagcacgcttctttgataactccatcagaagtaaaaaaagaagtttcacaatacaaagcaccaactagcagcgttaaaaataatatcttacacgtccacttaccagaattcaatggatcatcatcacaagggaaaagatacgcaaacacaatttattataagctgactagtaaaacatataagggtattatcattgatcttaggaataacctaggtggtgatattggcccaatgttagctggaatttcgccagttgtccctaatggaaaattatttgaagtagttaatgcggcaaacaagcctacaagtgtgaccttccaagggagtgttactaacaacatgggaactaagatagacctcggcaaggtaaaaaaaatcacaggaattcctgttgcggtgatactcaatcgattgactgctagttcaggcgagttaacggctttagcacttgaaaccaatcccaacgttaaaacttttggtggtaactctgctgggtatactagtatcaacgatacgtacactatgtataatggtgcccaagtaaacataactgctgaaaaaatcaagaaaaacaatgggcaagtactcttcaataataaaattaaacctgaagtgcaaactaacaggccaattgttcaagcaaacaattggctattaactcaaaactagtttttggttagagtcggttgatcgctagcttccgctgtataatggattaagcaagcaagttttttctacgtaaagtcaagtatattaggactctaaagttttaagggcggtggctgtcttttcccttgcgaggtgaggcccatgggaacatggaataatcttcaggaaggtttcacagtcaatgagcgtcttccagacactctcgttgatgttgctatttgcaatgtttattttagcgttgctaacgtacatcgacaaaagaaacaaataaaaaagccgccctgcgtaactttggccagttacagggtagcttaatgctgtcttattaacttcgccaccgcctttgaagcggcttgcatgggaagccctgttctagcgggactttccttctcttgtcacattataacatgactataactgactttcgactatttttaatcagctttctagcagtttaagggaacgtacgtttgctttttgtgctacaatacaggtaaaagctaacggaagtgatctaaattttttttgatgatgaaccgcatggcgtgttcttcttaatcgataacaagtccttttatgctagttgcgaagccgttgcccgggggcttaatcccttaaaagtccccttagtggtccttagtgaagctgaaaacaccaatggtgggcttattttagccacgtcacccgaagctaagcatgtatttcatcttaaagccaatgtctcccgtaaacgtgacttacccaatgaccccaggctttgggtcgtgccaccgcgcatgaacctttatattcaacgtaatttgcagatcaatcagatctttcatcaatttaccaccgaaaaagaggtttggccgtattcaattgatgaaagcattcttgatatgacccatacttggcggctgtttggcaattccgttcgcgaagtggcacgcttgattcaaaagacagttcggcaaaaactaggcttgtataccaccgtggggattggtgacaacccggtgcaagctaaattagccttagacctttacgctaaacataatcatgaattgatcggtgaaatccattacgaaactgttccggataagatttggtcaattgatgagttaacggacgtttggggtattggcccccgcatggccaaacgtttgaaccgccttcacattcacaatatgtatgagctagcccataccaacccttatttactcaaacagcagcttggcgtcattggtagccagttatttgctacggcctggggaattgatcgcgcacaagtcacggaaccaactacggttaaagcagctagcctgggtaattcacaagtgctaccacgggactattttaaccaagccgaaatcgaaacggtcattaaagaaattggggaacaggtggcggcgcggcttcggcaccaccataaactggcggggtgtctatcgctaagcattgggttttcctatgccgtagctgaagcagatggtcgcggtggttttaaccaggctttaaaaatggaaccaactaatgacaatcaagttttgacacaacaattattgtggttattccgtcagaattgggacggtcaagctgtccggaatattggtgtttatagcagtaaactaagtgccaattccggccaacaacttaatttatttgaaaccccgcacaaccaaattcgccgtagccggttaaaccaagtgattgatgaaattcaccggcaatttgggttcaccaaactagtttacgcgaccagtttattaaagggaggcaccgctatcaagcgggcttcactagtgggcggacataatggaggcaatagctatgaatagcgatatcgagattattaaggggcggttaaccttattgtttaagcggcgtccccaaacccgctattggttaatgttgactaatgacacctacgatcagacctataatctgttttttaacagtcaacgggctaatgagcgcttgcaatccgttcccttacataaattagcacactatgatttagctgatttagaaaagctgttaaaagcattacgacaagatataaagctaacgatcgaatttgtcggctttacaggagaacggtggccggcaagtcaaaagctgattcagcgaaagcgggtgccccttgaataaccaagactttgatttaggcacggttaagcatttttttgaacacgattatcatgaccggggcatgatgaaatggcagggcttctatttatccgatcatactgccgctttaaaccaacagaaccagcagttgaatgaaatatacgttccacgaccgcaacaatccttagcagtaattaccgaggtattggcggacgcatatcagcgtcagcaaccagtgatcattcaactaaaaacggttgaccaaaacaaccgtcattggccagatatcaccaccttgattcatggttacaatgccaatgatattgtggttgatgctgatcggtttatcccactacaagaaattcgcaatgtggcctttaaaaatacggagaagctataaaattctagctctccgtatttttcttaacactttatttgctggctctgttttttctcattgctttattttaaacaattttacttcaatgtaggcaaaagaattcacagaccattgccattaattgataacgtttttcagatctcctgataaatatgcttttagattatcaacagtcatatgcaacaaccgatctcttgtctcatatggtgcccaagcaatatgtggggtaatataacaatttttggcctgtaataatgggctatcactagcaatgggctcccctttaacaacatcagtggcgtaggcataaattttgccttcattcaaggcattcttgatgtccgcttcattagccaatttgcctcgggccgtattcaatataataaccccatttttcattttggcaatcgtatcattattaattaaatcaattgtttctggtgtttggatcacatgcagactaagcacatcagattgccttaatagttcatcaaatgaaacctgctgaatccatgattcaggaacctttttaggacgatgattatagaaaataactttcatagaaaaagcgtgtcctattttagcaactttttgcgcaacatggccataaccgattattcctaaagttttcccttttaattctaatagcggtttttcccaaaaagtaaaatcaggagcctgtgcccaccggttttcatgaacaagctgattatgcaatccaacttggctagtcacttctaataataacgagaaagtaaattgtgccactgcgtcacttgcatatgtgggaatgttagtcaccacaaccttgttctggtgtgcgctctcaatatcaacgacatcataaccggttcccatgattccgatatacttcaatcgtgatgttttgctaatcacttcatgatctaggggtgttttgtgtgtaatgacgatatcagcatatttaattcgttttatgatttcagcgttatcgttaactggggtacgatcatataaagtgcagtcgcctaattcttgcaagcttttccaatttaaatctttgtttagttcatatccatctaaaagaacaattttcatagtgttaaatccccctatcttttcaatgttttagctgcattatgttctggttgtttaattgccgggttttgttcagaaaatgttttcagttgtttttgcgttcgattactgatttcatggtgtacatcatttaatttattttgtagttctgatttttgttgtggattagttgcttgctgaacttgttgttgcaagccttgataggacttattaagatcctgggctgatagcttttttagatcatgctcaggctctttttgggcttcttgtaagcctaattgtttggttaagccatcgctaagctcaatcactttgttgctcacttgctggatctcacttaaagcgctatggattacggctttatctttggcccaggtggccacgtaaccgagtgagtagttgctggtatcaacgccaatattttgcatggcaacatacgcgatcgcttcggcttgggtttcctgataggctcgtggccgatctttaaaggctgattttaatccatgtaactggctatgcgcatattcgtgatataacgtcttcaattttaaagcattatcggattcatcactaccaataacaatttcattagtgctgggttgaaaataccccttagccccatttagcgttgctaaaggcacttcactgactttaaggtcgggttgctggtttaaataatctttgaatgcgttatataagcttgtcacattctgatgatcggccaaattttctttgacaaagtctttagcacttaacactggttcaccgctagtttgtgacacatcgaagacgggtagataacgataaccgacaatggcccactcatcgatggtatcaaggcgcttttgctcagcgggtgttaatttcttaataatcggtgccgcaattcgaatggacttagcgcccttattaacggtgcggttaaaatctgtttgccattgcttaaatcccgcgacctgggtcgcttgcggattttgcgcataaatcaaatcaatgtttctggcgctataatgatggaatttagccaaggcattgaggtactttttaaattggccactatcagttaattttaggatttgttgttcagcctgggcgaccaattgtgctttccaggctttaacgtctgctttactcggcattgtctacccctcctcatcttcaaaaatatcattcaatgtcggcaatgatcttatttgaatcgaggtcgtgccataaagggcaacgtaaccgtcagataatttttgccaagctacttgataataagcgccgttaccagtgatttccttcaaatacttgtagggttctttagcctgcagaaccggtaattcactcccaatgactgctaattcgttatccatatttatgatctcctttgttttgctaatctcacccgttgtttaggtttacttttggggttgtaaaagtgaacctaaatgacgggttcaccaaccggaacaacgtgaagggcggtagacaggatctaatcaaaatcaaaacttaatttatggccgtcaagctttaacttggcgtcaaacgactttccttttttgctcttgaacccctttagtttgctggtttcccccttagtgattaaggctttgattgcagttttaccgagggttttactgctccatttcttgggcagggtaaagtcttcgccttgcttaggcttcacaatgtaaaacttctgtttatttaaaacggtcgcttgcggcgtttctaagaatacttcggcggctttttgcgcttgctgttggtgattgatttgttgcttaatggctgcactgccagtcaattgcgcggggacctcagcaatcaatttggccacgaactttttgatttggttcaaaaagttatctggggtacgttcttcggtactgatttgttgtaacgcttgctcccatttagccgtcatttctggactagttagcaagggctcaagttcaaccgctttacataaagtaattccggcttcactgacgtgtagcttgttcttttcagtgacgagatagccgcgtttctttaacacttccagcacattggcccgggttgcacttgtcccaatgccttgcacatctttaagaatcgcttgggctgcttcatcatcaagcgttttgccggcggtcttcatggccgtaatcagggtaccttcggtaaagggtaccggtggtgtcgtttctttttgcggtgtttgcagatttgcttgaacttggtcgccttggtgaacgagcggtaaagttgctacttcttgctggtcggctttgtgatcatcaaataaagcttgccaaccttgcttagttgggaccttacccgttgctttaaaattggcgtcaccaacttgggtaataatggtggtttcctcgtactcgtacggatcagcaaacatcgctaacgtcgttcttaaaaccaagtcatagacctgttgctgtaatttaggtaaggccgctaattgatttttcgtcggcacaactttagtcatgataatagcgtagtgttcttcaacctttttcccattgacgtaacgtttattcggggtggtattggttaaagcgacttgcttagagactaaccccagatacttcgtcagattagccactaaatactcaaattcttcatcagtgatataagcacaatcggttcggggatagctaaggaacttggcttcgtataaactctgaatggccgctaaggtttggctggcactggcatgataccgtttattcatcgcactttgcagactggatagcgagaatagttggggactggcactctttttagcctgcttttgcacgtccttgattaaaccgccctgtgagcctttctgaacgtgtttagcttgcatgaatgtcattagccctgtttcatctttaaaccgctgataggggtctaattttgcgacgaatttttgctgattggctaaaatttccgcatttagttcaaaatagggttccggcttaaagtttttgattgcctggtctctttgatagaccatatataaggttggcgtctgtactcgaccaatcgaatacaccccgcgtaccccgttttgtcttaataacaaagtatataaaggactgccattcataccaattaaccagtcactaatttgacgggtttgggcttctttataagccaaatagtctttgtgccaatcaccaagatttttaaagccggtaataatcgcgtctttttctaggctattcaaccaaaggcgcttaatcgttttcgacttaacatcaatatgcgcttggttcataatcgaccacgcgatatttgacccttctcggtcgctatctgtggcaacaataatggtatcggctttcgttagtaaatctttgacgactttaaactgcgttttcttatcggttggcacgataagcttgtatttatcggggaaaatcggtaaattagatagcgcccattgcttgtacttttgatcgtatttttctggtgttgctaattcgaccaaatggccgaatccatacgtgattacagtattttggggcaaaacagggtcactaaccgtatagtaaccctgtttttttgtgcttttttgaaatgcctcaacgtatgaccttgcttggctcggtttttcagctaagattactgtgtttgacattttaatgtttccccctttactgtcctctaagcatgtttcgtccaatattacccataccacgcataactgaccgtccagcacttttggtaatccctgttgaagcccaaaagtcttgaattacatgtggtgtgtgtagtactaaccagccaaaaccaatagttcccataaaggcaacaaagctccattttgagccaatatgtgtgaaacaccaaattgataaggttagtgataacacttgggacaacatggaaacattgtaatagactaattttttccaccaggttgagctataatcaaaactttcactggcaatcgacatagcaacaatcgggattgataagttataaaatgccatatctgcaaagtagatacacattttaaggaaaaatgctacggttacgattgcaaaaaaggctagaaatagtatttgcataaatcctgtaattttaatgcttttcgtgacttgtgatgttgaataaacagcgtctgcggaaaatttaccactcatatcaaacatgccttttgcaagtggtaagatgattcttgtttgcaaaaatgcttgtaaaaagaccatgaccggaattgcaattgcggatctaacagcgtctataataatgttcgcccacgttacatctgtactttcgtccgcctcgccaataagtgtaatgataattcttgctaggacaaccacgacaaccattgatgtcgcaaaagcaagaaatataccgtaccatgtatcaatgattggtagagatgtacttaattggtctaaaattgcttttacacctgatacagcaaagttcatgattgctttaaatacatctttcaaccagtcgtttattttatctccaataattgacccaacaacaaaattttgtgagtacatacgctttcctccttactttgagactaagttgtttttatctgtcataccatacattgcatttttagctggttgattagttttacctttatccaaaatcaatgagtagccactatctgtttttttgattttgaagtaatatttaccgtcacttcctaaatcttcgtggtgtgtaagtttcaaatattcaacattaccttgctttttgattgagtatttaaaattctcggtcattggttctttccctaaaatcatggtgttatcttttttaaaattaacggtattgctttcttcttggcttgttaaagtccattcttgtgcttgtaacttttctgcggtggttttatgtccaaatataaaagcaatacctagtaggactactaaaaatgctagaacaatactagcaattgtgattttcttattactcatcaatatagcctcctaaaagtccacatcttcgttttcgttttgaacgctttcttgttgtttcgttgcctggtctaattcgtcttgcatatcttcttcttcttcgggttttacatcattctttgctcttgtagctttggcttttgctaactccgcttcccactttttgtttgcttcgttaaactttgtaacctgacttcctgaaggttcattggtgtagtcgttttgtttcaattcaactaaatgatcagcaccagggaacaacttaaattgaaaagcctttgttgctttaattggtcgttgatttgagaaaattaatatactttgtgtatctggcattcgcatgatctcgtcaggcgtcatgagtgaacggctagtatagctgtaactatcacttttgctgtgactttcttccttgctatgactggtactctcactaccggtttccacttttacggtcgatttacctaacaaatcactaaagtatttagcggtcacgtcattagcggcattcaagcaaattttaaccgcatgattacctaagatactctcggccttatccttgccatacaaagcttggagctgggttaaggtttgacaaatggtggtgacgccaatgccgtaccctcgacacgtcgctaggaactcctcatacttgggaaacttccccaaattgacaaattcatcaaggataaagtctactggattaggtaattttgctccgttatcggacgctaatttgtataattcatcaaacaattgtgagaaaaacagattgatgaagctttcataagtgttatccatgacggggataattacatatagcacaactttggcgttgccaatatcttttaaatcaaaatctgaaaatcctgtaaagtcggcaacttcggcgtcaacaaacttgctgacggttgctaacaagctttcaatgatactggctttcatctctcctttggcttttttgaaacctagttcataagctcgtctagctggatcagtcatgtttaagtctaagaaaagtgaatctagggggctatcagtttcatctttgtctggttcaacatcaaacttttgtaaaacgttggtaactcctgctaagttgcgttcttttggctctctgtggttcattacaaataagattaaggctttcagcaactgacgttgggtactgaaccacacatcttttttgccctcggcattttcactttgcacgatctttgttgccacggtttcagcttgaatatctcgttcgatataatcaaacggattataccgatcagaatgtatcatgttcgcaaaatttacaacatggacttgatagccctgagcgactttaatacctgctgtcttttcgtaaagttctccctttgggtcggttacgacaatactgttttgtgtttcgttaaaaagatttgtaataacaaccgattgcgttttgtaagaacctggacccccgacaacgaacacgtttcggttgggcttggtgctgttattttggtaaataatttgcttatcaaccatacctagaattgtaccgttcatttctgctcccccttatcctgcaactgcttaataacgtctgaattcaggctttcattaaactgactgcttaaatctttggaacttatcgtaaaatattgtgttaataaatcttttacgtttccccatgtcgcactaccatgggtgtccgtatctgctgtttcccacgctttgtgcttgctattgcgtttcaaagcaaaataaatggtgtataggaccacagcgatactgacgataattaataccgggttcttttgacccaaatacaagttgtaatagtgccaggggtgcaaggctaattgttttaatacggttggcatatgatccgcaaaagttagcttatagtgcgacaaggccatgactgatccagctaaaatctccgctaaatacaagccaatgattagcgttagtagatatggccagctgactttaacgctgtttaataatttgtctttcatctaatcacctactatctgtttaatcctttgttggttggtaccggagtatcgttgcttgccatggatcaaggttggtactgacgttaattgatatttttgaatgtaatgccgattctgcggttggttcatgttaatcaagacgatgttgtgattgattgcgttgtgccaataaatctgatgaaaaattgactgacaatctgaacaatcgtcccgatagaaaaacaaagtttgcttagtatcttttggtatctgaactatttctcgtcttttctcaatcgtattgatgtagttatgtccgataaaaattaccataattgctaataccgccaagatagcaagtgttttgataattttattgaatgtctgacgcttcaaagctatctcctaaacttttgaccttagtcaactgtttggcggtcgtatcataacttaattgatacaaaacagtttgttttttaaagtcgttgctacctgttttactttcaaatgtgatgacggctaatccgtcaatattttggtcttgcttggctcgggtataaaccttggcttggtctagctttgaagaaacgttattactatcaccaaaattttgattacttgggaaatattggttatataaatcatttgaaattaaacctttaatatgttccttgcgggttttgtatgaatcaggttcaaatgtaaacatatactttaaaaactcgtttgtggtgttgttaaagtcaatttctgcggtacttttgtctttattattttggtaggtcttataactgtcaatttgggtgctcaataactgcttttgttggttggttttagtcaattgctgactaacttgtcgcttctgctgttgtaagcgactgatctgttgttgcgcctgcttaacttggctatgttgataggcattcgttcctaatgacataattaagatcaaactaccaagtgcaatacttaaaaccacgctacgcttcatttgttggttcctccttacttcttgattggccgggctaacgttacatcgctaccacttagtaagctataaaaggcggtgccaaaggtgctttcgtttacatgtcctgtggtatctccaccctcttcaataatctttgtgtttttaccatgccaattttcggtaataaaagcggtgtgtccgttatttcctgcacccgcaccctgattgacaatgacaatatcgcctactttggcgtcattttcactaatttgtttcaagtattggtgtgatcctttagcgtcacttgccattgttccagtaaaccagcccatatttgcgggaactttgtagcctgccttgttcaaggtaagccagataaatcctgaacaatcagttgttcctgatttgttaggattttttaagttagttcctaaatcagcgctagggtgcgattgcccatacttgaaataacctttcatactcttggctgttttaattatattgccgtctgccttgcctgtatcggtatcactagcgcaatctagattagcgttggcttcctcatcttggctagcattttttaagctatcccctgcaactggatcttttgtaccaattactgaataccagtgatctgcaaaggcataacgctttgacaaaaaccattgttcagggtttttagacataccctcgtaatccattaaccaggctttggtcgctttgtgcacgtccgtatatttaaaaatctgcttgtttgacgcatagtaactactgttcaattcttggtcgagataatccaactgtaccccgagattggtcgctggtttgctttctttgtgggctaagtcctccaacttatctttacggccgcctaaccactgggctaagcccgtggccccggaactggaattaacagacttgggatcaaggcgactttctagttgtaagactcccaagataccggcggccgcttgtggggtggcaccatacttttgcttccaatgcttagcaatgtttttcgcattttcttccatacctttatcgtctaaattggtaacttggcttgatgtggtatcatctccacaattttcttctaaatctcctgttaatcctgcaattatcaatataattgctatgaaaaagcctacgataccatataatatgaatttgatttttttcttttgaaattcataggctagtcccatgttaagcacctactttttgctttgccttatcaactttatcttgcgctgctgattggtcactctgcgcgttctttaagtccgacttagccgaatccaccttcttatctttatccttatctttgctgccatcaatcttgttggcgtcatctaacttcttttgggcgtcgccaacttcgttcttagcggcattgagacttaacagggctttcaaatacttagctttaggactattcacaccggctaatttggtttggacggtctgggcgtcttgcgtatcattatgggcgaggaaggcttgtcccattctcaataaaacatcagcgttcgtcgtaaaggataattggttattaagcgtattggtatcgtagttaacgatggctttttcaagtttcaactggtctttttgcttgcttgtcgccttagttggcaattcccacttggcaacctgcccgctatccttgttggcataagccgtgttgacaaccttattcaactggcttgggtcaacctttaaagcttgctggtactgaccatgctttaaaaagacattgacttgcttagttgcaggatagccggctcgttgcatatctttttgtgcttctgaccacttatgatcatttaaagcggtctgaatttgaccgctatattttaatcgcgtgacctgggcttggttctggttagctaagctttgatactttctttcgtcacttttatggactaagccgacggccaaaacggccacaatcgccactccggccacgctcaaccacaaacgttgtttggttttctgctgagccgtttcaacttcctgccattcgtgataactcacaaagtcctcaatgctgttaaccacttccgttaactcatttaacgacgtagctttagctacttgttgtaaatagtcgtccgggtgtttagctagggcttctttaggattgcttagtagccgttcatagggcgtccccgtcaagcaaaatagaatcagcgctttgtatttggctaaattgctatgtttgtcatcataaggcatgagttcattggcgcgataggcgtaccaaacatgttgcatggggtaataccacagattagctggatttaacgcaatatgatactggctatcagcaaccaccttttgcgccataattttcttggcaatggctgcccggatcgccttattttcctgcggtaattcctttaatgatctgaccttatccggcaaggtataagttaaaacgaccttctgatcttgctcaaccacgttaaccaactgcaagaaattggcatcagcttgctttaattcgtttagctcactcaactggtcgtatcgaaactgattgtgattgagttcgaggattaacttgtttccttgtcgcttgaacgtgccgacctcgatatttaatagctgatttgatttactcatttaaagtccctccttcctcttcagtagtcgtcaaagcgtcaatctcactgggagttaagatcacgcgcttttgataatccggttgaatggctgtctcacggttgtatttttcttggtaagcttcgggatcaattaaccgcaattcttcttcggtcaactcgacacgcataaaggcgcgttggctaccatagatcatcagggcttcaccttgccggcggcgctccaataatttcttttctttatccgagaacgtcattctcaacttagtaatcacatcatcaacgcctttaccgtctaacccgaaaaagattttcgtgtaggagttaccgataatagcttcacctatgttttgaccgatatcagtcgtgccttcgatcacatcttgaatttgctgcgttccggcaatggctccggcattgtactttctaaaccgcttgtatgcttggtggaaaaaggtggcggccgctttatgcaaggttaaaaagtgaaattcatcaacaaacaatttcttgcggctatgccgatctttggttatttcgtcccacaaatactggaaggtattcagataagccgctgattggacttcctgttcactttgcaggggttttaaatcaaaagaaatgatcttcccctttaagttaacgttggtgtgtccgtcaaataggctgttagagccatgggtataactacctaagatgtagtaaaagtctttaacccgactgaatttgtcagtgtccttatctgccagtttttccaactcatcataaacattggataaggtcggccactgatcatctttaatttcttttaagcggctatatttcaaaacgccactgttgacgtaagcttgtttaacgacatcatcaaggattgccagttcaacttgagtaatcccggttttaaggacttcaaagaacccctttaatcgctggattttgtctttgactagtaaatcaaggttcgtgaccgcttcatcagcgcttaagatttcttcggagaaaatttggagcgggttaattttatattttgcgttagatgttagatgcaagactgcgccgcctaaggcttcgacaatcttggtatattcattttctggatcaataatgtagatttgataatcttgaatggcatagcgtaggattttttggatcatataggtggtcttgccgacccccgaggtgccgataatcacttggttttggttaagcgtcttattgcgatccaacatatctacggcaattaagctgttagtatctttgttgacaccctcaatatcacttctcggctttaagtccaaaatttcggcgtcatcaaagggaaacatactgctggcaacttcggtattactttctttgtacgtgtaatcccccatgaggttctcgttaattggcatggttgaccaaaatgcttgaaaggttgctttaaccggtactagcggtttcatctgtagcttaatcaacgtattcttaacgttttcggttaagtcgtctagttctgctaaactgttggcccgcagataaaccagcatatgttggtagacaaatgtggtagaattatcaaggtatttatctagttgcatgttggctgaatcaatataattttgcagaatcttctttttatacgggtcgaacgtattgagcttctgcgcttccttattttgaatcgtcttcttgtaataggtaatcattgaattgttactggcgctgtcgatatattgcacaatatcgataacgccttttttgcgctttaactccgataaccagttgccatacacccgttttggataatcagcgatcgctaacacccgaataaaattctcacccgactggacgtaggtggggtactgttcccagctaaacgggaatagtgaatgcaagctatcgcgatcaatcagcttggtaaagtcttcaacctccggtttttgtttattaaccgctggttcactattttgctgacttcctttcttggttggcatgaacaaatcaatgactttatcaccaaaattcattttgtttccccctatccattaaaattgatcaagttctttaagatctcctggacttcctgactggtcaacactttggccgtcacatcaaagtctgttaacgcattttcaatgtctcgtttaacctgttcgatcttttcgtctaaatgagtgaccgctaggtttaagctcgtaacacttttgtccttaattggcaccttaacgattagcagatgttgcttagttgtcatgtttttggattcttggactttagtaaagtgatccaaataactggctatgagctggattttgaactgttgctcggggtgatctttttgtaaagcgagataccgccgtttgagaccattgagataagctgtcatattgacgggaattgtcggctctaagaactgtaaggtgtcatcaaccccttcacctaacgtactcatgagaaaggcgccatagtcctcaaagacgtcttgctgttcggtttcattaagtagatccaggttgatcccactaacttccaaaataccaacgaaattacccgttttggtaacttcgtaattaccatacatacccaccaccaagctcatgtcatcaatggtttctttgccaccattgattttgggcggttggtaatcccaatctagcctggctgatttattggcggttttgttcttcttcaaacgcatttagttcacctcgcttcttcggttttaaataaaacagtttctgaccattggcatagcggcgtttaagcttaaagttatcccgcactttaatattcttccgcgccgcaactggccgaattgttaaaatagccatgacaatcgtcatggctaagacaacaatcactatttttatcaggactaagatcagaccatagggtgggatcgcaataaaaattaagcccactagtcctgccagcgccgcatagccaaaatccttcaaggtgtagtctttccagatcccgtaatctttatccacgttttctgggaagataaattcttttcctttcttcatttggcaggctcctttttaaattaagtaaataggctgtaaacccaaggtaatagccagataatcgctgccgctagggccactaaaccagccacccgaccaaccgcgtgataaacctctgatttctctcttggatcgtctgcgtcaggcattcttttgataataataaatagtgcgacacaaatcccgactaaaacgaccaacccagttaaaataccttgaatcgtcttaccagcgctggttagcttgcttttaacttcgccaccgtccgccgccaaaacaacctgggcgttcatcaagcccaaataaatcgcagtagctccagtagttgatagcgctttcatttttctgtattttgacatgttattcctccttcctatcgtcttctgatgttcgtaattgaatttgttctgcctgcgtttcttctggctcacgctgatagaacttgttcaattgttcctcggcaatttgctggcttggtaatggatcggtggctaatctgacgtggccattttcactcgtggctaagtaatactctttttctgactggcctaactcttgggtctctaggacatgcaagttatgttcataacggcctaaggcgttatcaacttctaagccatagaagcctaagaagccttccaagaagctctcaccaaaaaaggtcatttcatttttgatttgcttatattgatgagttggcttattacttaccagcttttcggctttttgagcattgtcactctcatgtttacggtcaaaccaagcactgatttttattggatcggttttgaccctacttttgactgacttctgaactaacttacttctaacttctgtgactggcttaccgcttctttgcatttcggtttttaacgcttcgggattatccagtagttttgaatccttaacaataattgctttgtcattatcaactaccaaatgttcgtccacatcttgccagttctctatcttcattgcgccaccccctttaaatggttattaagtatatctagcctatccattcatactcatgtaaaatggtatgttagggtgttttcctaaaacggtcatttttaggaatttatcctcaatagcactaaccttgcttttgaggacgccctctttttttgtgtgttcagaaatccattgaatacctttatcatgaatgattttcttacctgaaatatccattagcattggcttggggaaatcatcatgacgctttatccaattactcacatagcggtcattttttcctaaaattcggctagcctccgctaatgtgtgccactcgttgctatttttcaaatgctatcccccctttctttatttgtatgagactgaaaaaagcccatgatcactatctaagttggttgaaatttaaaaacaaattatagcttggcggttcagtccatgctgacagctttgcctgcttccggaattaattgggcaagcactagtttaaaaagcatccgttacttgccagtatttcaaccagcaagcagcggatgctttcatcattaacgatacaattcgaatttctcgtaactagcagcccacgtgaagtgccaacttaacgcgcattggccaccatggatttgtacaaagacccgctcagcgtagtcccgactgcgattgcttgccgattccaagtaagatccagtaatgaatcgtttcaaacgatgtgataacgagcacgatcaattggcagtggtccacctcaaatttcgattcccatgccctgatacacatccgcatacatcgtctgctgatcaggataaagtcgctgcgtttccggcgcgtatgccagttgccccttactcagcttctcaagtactttagctttgtccaagttcaagttaaatttatgattgattttcaacaagaaatcatcgatatcacacggttgctggcctaattcttgtgctaaaaagttaacaagcggcgggcacacgggcgttgggtgggtttcattgataaatatgacgccacgcgtcttgatggttcgaatcgatgggatggtaaagatcagccgttcatacgcttcatcactaaagccagtcttcgccataaaagaactttcaaatccggcatccaccaatgatttccacgtaaagaagacatcatcatcaacgaacgccaccacttcttgcaaaaagttatcaatatcagccttagtcaatcctaacttatttaagcccctaatcgtcagataacgtgtgggatccatcgcaatcaagtcatgccgtaactcaagttggtaggctttgagtgtaaaccagcgattcgggtatgctttaagttcatccgtcgaaacgtagtcatccacgagccacagcttcttcaacgcgtcgtctaaggaatgacaatcctttctcattaacaggccactacgttcaacgtagccgagcttgtccaccaataagggggagacttgtactgcggggtcaatcagtttaataattcccgcaacttgctcgaacggatagagcgattgatcaaggacaatctgcatctttgcatagaattctggactggttggtaactttgcattcatcgtaatcgtattattatgaatatattttttataaaccttattgatataggcccacactgacacccgtttcaactgatagctggcttgcaggtgatcggcgacatcatcggcggtttgaccatcaaattgcaataaaatatccaggtaaaacttatccttgctagcctcatcattattgatacgaccaatgtatacctgggactgacgaacgatcgtattcaaccgatcaaattgttcatacccgagtgcctttaacagattagccaattcagaactttcgcgaatatcgatttcagccattaaagcctgattctgttcaaaaaagtaatcgattccataaattccatcggcaacttcaaataacgcattaatttcatccagataatcgctgacatcgctcagagcaagttcataatagcggaaatagccattcgttcgttgaataatgtgcggttgccgctcagcttgagcctgtagcgcccgttctgaaagttctgggccatgcgcctgaccatgtgcacggaagaacttatcaagctcgaccaacaatgtttcccgcgtaaaaacgttccgatgagtaaatagaatttcatcaatgacatgactagtcgtcaaatccacgattcggttagcatggttcacaaatttttgtcgacagttcaagcgttcagccagcacttctggcgcaaccttattgagcgacaacaggtactggtctactgacttcaagtttttaggtcgtttgtacttgatttgaatgtactcaaagatttcgggggttccctgggtgtaattcaagaattgatcaagttgaatgtcataacttaggactaatttcttatacttttcaacatcatcaaataacggtaatcgctttacgatttggtcgacaatttgccggacccgctcacgtgtcagtccgtaagcatcaccaatttcttgcaaagtcagtcctgacagccgtccaaccaaaaaatccttctttttgaagtctaaatccagaaaagccatcagcgtattgggcacctgttcgattcctagccacttaatcatgtggcgctgctcattatgactgttcacgcgatgttgtagtgtcgcgctcaagtcaacttccggtattgtttcaagctcttggtcgattgctgcttggctaatcatctgccaatcacggtaccgttgaataatttcgagattcttttcgggcgctttgcgccaatagcttggcagcttcatctgattgttaatcatataatccagttgcgacacggtattaataccattacgcctcaacgtctgaaccaacttgtcatcggcaccacccatcactaaaaagcagaccgaatccagcaccgcttgtcgatggttctgccattcagtttgagccgcctgaatctcccgcaccgcatgggtactcctacgttcgacaagctgctcccacagcaccggtacgttatgttcattaataatctgataaaagtggcaatcactggcatccagtttttccaaggtattctggctaagtcccaacgccgctaaggtgcaatacataattggattcttcatcactatcacggtcctttttaagcaagccgcaatactgttactgaagcccgcttcaatttcgcttatatttaaattcattatagatgtaaacgtcgcttcatggaagctgtcccggccttttccaatcaattgttaacgaaacactaacaccgtctagtcattatttatttttcaaagtcactctgctacgcgtaatggccttcgtaatcgagtatggtatattataatgtagtttaaatagtacataacaggttagtacgggagcattacaaagatccgagtatcgttgaactaacggcttatccaataccaatcaaaataacgaggttctcaccatgcaaacaattcagttaagcaacatctttaaacaacaagcacaccaaacgattttaaaagatttcacactcaccattccagcgcaaagcaacatcggcattcagatgagccacgttgaggcaacgaccttctttaacctattacgccaaacgacgccccaaactagtggcgtcatgactggtctcactctcgcacgtatccaagccatctttcatgatgacggcttttatccgcaattaaccgtctcgacttatttgaagacctttcaacacatcagcacctttgagacggatctggatgacattttgcagtatttcgcactcaaagacgtcgcccatactaagatcaagcacttatcctttgatcaacaacaacgtctggccatactgcgggcgttcatcctacaaccggacttgttgctaattgaaagtcccctgaccaacttgaccaacgctggcattgagctgtacttagcagccttagcctatactcgcgaacacggtgtcaccgtactgctgacctcctactcattagaagaacttgtcctaaccagtacgactatctttcgttatcgaccaaaccagggcctcgagttgactgatttggcgaccgaaagcagttccgattccgcacacacttcagaagatacacctagaccaatttttaaagttgcaagtaaggttgaagataaaacagtctttttcagccctaacgagatcgattttattgaaagtgtcaacggggtcagtcaactgaacgtcagtggcgaacaattcacatcatcgcaaacaatgagcgaattagaacaacaattgacgacgctcggcttctttcgctgtcatcgttcttacttggttaatttacaacaaatcgcggaactgatcagttactcccgaaatagttacacgttaatcttgaaaaacaaaagtaaactgcccctctctcgcggtaaactcactgatttaaaagctttgatcaatttttaggacaccattcagcctaaataacgcaccattcggctccaatatgccccattacgacctgatttaatcacattctgcatttgttccagtaaactagattttgttgaagccaccgcgcttccaaatcaaatttaaaggagtcagcgatcaacgatgacaataaaaaatgcaatcgaagtgattaacattgccaaatcatttcaaaatacgaccgcgctggaccaagttagttttaccgtccagccaggtgaaatttttggctttttaggtccctctggatcgggaaaaacaaccaccattaaaattctaaccggacaattattaccaacaaacggtgaagcctacgtcctgggtcagtctgtccaagcatacgacgaacaccgctatgaaaaaatcggcatcgtcacgcatcaaagtgggctttacgacaaattatcggtataccaaaacctactattcttcgcgaaaatgtttggtgtcccggttgcacgtgttgataagttacttgaacgagttggtctcagtcaacataagaaaaaactcgctggtaagttatctcaaggtatgcgtcaacggctagttctggcccgagcaattcttcaccaaccgcaagtcttgttcctcgacgagccaaccagtggtttagatccccgcacgacccaaacaattcacgcactgattagggaattacgcgaccagggtacagcgattctgctaacgactcatgatatgctggaagccactcgtctctgcaatcgtgtcgccttactcaacgctggccgcatcgcagaatgtgcagccccacaagcattgcaattaaaatataatcgcgaccagcagtatcgcgtccacattgcatcggcagcgcaagatttgttactccccgcatctcctgagacgacctatcagattaatcagtggatgctttctgggcaacttgagacgattcactcgtgcgagccgacccttgaagatgtctttttagccgtaactggaaggagcctaaaatgagtttatcagtaaccaaaataaaagccatattcggtcttaaattaagactgatcatttcaaatatgagtctaatgactgccccaatcatggccattttgtacgtcgttttcatgaagagtattatgcaaagtaaagcaccatcacacgtcgccctgatttccctattactgggaatgggactatgctttaatatcgttatgggtggcatcatgatgacgagttatcccttagccgaagaaaaagaacaccatacgttacgtgtcctaatgacctcttccattaccgggcccgaattttttatcggtagtttattgccaccactagctattatgactgtaaccaatttgatactggtccccctaagcggcgccagttggtcgcaaattcacttaggaaactttttattgattaccattatcactagtttaacgagtctcgtgctcggatacattattggtctgatcgctaatagtcaaactcaagcaggtgtctacagtattccaatgatgttgattttaagcctgatgccgaatttcgaacagttcaataccactcttaaatcctttagcagttatctgtatagtagcacgcttaatcactatattaccgcctcgtataccactggtggcttttcatggacacttcacgaagccctcacgcaactcggatggctcgtgattgcctgtggcatcttcttctatgcctaccgtcgtcacggtcttgataatgattaaccattaggaggttctcaatcatgccaactttaaagattggaacgaccgtcaagttaccaaaaccatacttcggaattgcgggaacgatcattgcctactacgcagctaaagatcaatacttagttcggtttggtgttagccaacaactctacttcaaaccagatgaactaattgtctggaaatcttaactgcttatctcataccaagccccttactttgaaatatcatggtaaggggcttcttttccacgttcggacaatcccgcagccgaatcgacgttggctatgttatagcaatggccgctcagcctagaaggtgtatgtaggacgcacatttactgatgaccagtaatctaactaacacatttttatcataattgatgacagctcaatgcatgctatgtatacccataatatttttaaaatcataacttacccttaattttaaaccccacttgcactcaaaatggggtttaagcctcacatgctgtcttgatgatgtggtgctttttctgaaacctgttatcctctttaatgcacacacggggttttacgcaaaaaataggcaattaagggagcgcaagtaaagatgattaaagcagaatgggcgtatatgcgcaaacacaaactaatgattatcgtcatggcaatcattatgttcattccatcaatttatgccgtgacatttttacggtcgatgtgggatccatacggtcggttaaataatttacccgtagccgtcgtcaatcacgatcagccagtcacgtaccaagggaagcatctcagtgttggacgcaatttaacaacgaatttaaaaaaatctgacgctttaaagtttcaccaagtcagtgcaagtgaagcgcaagctggcttgaaaaacggccgctattacatggtgctcacgatttcacgcactttctcacgccacgcaaccaccttactcgatcaccaaccacaagccatggtgctacactacgacaccagtgctggacataactttgtcgctagcaagatggccgattccgccgctacttcgattcggtcatccgtcgcccaaacgattacaacgagctatgccaaaacgatgtttgctgctatcaaacaacttgacggtggtctcaaaacagcggctaccaataatcaaaagctcgcgactggtgggcagcagctccaaaccgccaaccaaaaaatcgccaccaacctggacaccctggcaactagttcgctgaaactaaaacaagggagtcaaacactaacgatcggtttaaaccaatatctgaatggcgtttcacaactacaggcgggaaaccaaaaagtagtcgccggtctaacacaactgctcgtcaaaagtaatcagttagttgctggcatgggccaactcaacagcggcgcccaaacactaaatcaaggcgttaatcaatacgttgccggcgcccagcgagtgaatactgggactgtcaaagtcaatactggtgcccaccaggtggccagcggcgcgcaacaattcagtagcggtaccgctcaactggcgactggtacacaacagcttggttccggtttaaacgcttatgtggccggtgtcggcaaggtcaacattggtgccagcaagcttagtcaaggtgctactcaactacaagcacagaccgctcagttaacgactaaaacgacggctctaacgaacggctcaagtcagctaactactggcatccagacactaggtcaaaacagtcaggccctcaccaccggcttgcaaaaattgcagacgcagcttaagcaaccaaccaatgatcaagccacgatcaacgcaaccgtggcagcgctgaaaaaacaggctgctgggactgacttatcgtccgttaaaaccgcgctaagtgcgctaacaacggctattaaaactagtgcgacgcttcatgacaatgtcgccgcaaccgctgacagtcaaaaattgaccgcggcacaaaaatcagccattttggcaacggttgatcaatccgctaaccgtgacgccattaacggtgcccttgcgagtttaaccacagccatcgcccaatcgacgcaaccggctgtcgatacgaccgctttgactcgggccctcagtaccacgactcaacaacagaaaggccttgcaaccacggtcaaccaactcactaccggtgcccaatcactgacgaccggtattcaatctgctggtaccgcggctaacaagctgaggactagtctaacccagctgaacacggtcctacctaatctcactaatggcattggggccgtcactactggtgcgacaaacttggctagcggaacaacaacgctcacaactaatagccagcagctcactcaaggctttaaaacactggatgcaaacactagcttgctcaatcagaagagtcaacaactggctacaggtgcgggacaagttgctgcgggttctcaacagctgaccgcgggcacgcgtcaactcagctcccagggcaaccagctaacacaaggtgccagccgcgtggctacgggtctacaagctgcacagaccaacctgccaagcttaacaactggcattgcacaattaactactgggagtcagcaggtcgcgaccggcttaaatcggctcggcacagcgggtactgcacttgctaatggcagccaacaactcactagtggcaatggacaattagcaactggcgctcagcaactggccacgggcgctaaccgggtcacaactgctggtcaaaaaattcaagcgggtaaccagactttggcaaccaaattaggaacggccgcaaacaagggtaaagtcaacccatcaacactgacctatcaacaagttgccaagcccgtcaccacgactcaccaggaccgtgatgacgtcccaaataacggtactggcatggcaccgtacatgctgagtgtttcgctcttcgtcggtgccctcgctctcaacatgatgttcaatatgtatacgccacgcaagcatccagattcagcgctaggctggtggagtagtaaagccagtatcatgctcggcttttcaatcatggaaagtacgattatgctcggcttgatgatgttgatcaacggactcagcccgattcatccctgggccacttggttgctactcacgttaacagcactactcttcatgacaatcgttgcttggcttaacctagtcctcggcaaggccggtgccttcttcagtatggtgctactagtcttacagctcggtagttcagcgggaacgtacccgattcagttatcaggtcactttttccaagtcatccatccgtggttaccaatgagttacagcgtgaacggcttgcgacagaccctaatgactggtaattctgctcttcctgagatgggcatcttgacactgtttctagtgctgtttatcgccctgacctggttgttctttatccgccgttacccacggctggctaaaatcgactttgaagaccccgtcgccgtcaaagccactcagagtaagttagctacgctggttcagcgaagagctcaggccaaagcatccgacaaccaggcggattagccacttgaattgacgctatcgcatcaaggtagccatcacagaacgactttctctaattcggagaaagtcgtttttttcatcatccaaccgctctcaccaccaaattactaggtgacttggcccgtcagcgcactccaaccgaatttctgacgcaaccacactgcgtatccagcaccgattaagtcactatccaaacaaaactaatcatgatactgactcaaatcaaaatgggtatgctttaatgaggaatcaacttacggttgaattagattggtgttttgattgagtcagcgtttgattttggctatactgttaacagcaattaataaaggagtgcgagtcacatgatcaaagaattcaaggaatttattgcccgcggcaacgtgattgatttagccgttggggttattattgggtctgctttcaccgctatcgtcaaatcattgacggacaacttaatcaatccactgattgggattttcttaggcagagtcgatttatctaacctaaagttcagtatcggggacgccaccttcaaatacggggcctttctaaatgccatcatcaatttcttcatcgtcgccatcgttgttttcattctggtgaaaattattaataaagtggttaaaaatgaaccagaagaacccgaggaagaagaagtcgatgtttccgcgcaatatctagaagaaattcgtgatttattaaaggaacaggctaaaaaataaatgaaaatagctcccaagcaaatttttcattaaaagtctatatggtattaaaactttttttgagatacaatatattgtgcaattttttataaagaggggctatcatggtgataataacagcaggaatgattggggtcggcaaaaccacgttaacggggttaattgctgaccaccttggaactaaggcattttacgaaccggttggcgacaaccccgtattgccactttattattcggatcctaagaattacgggttcctattacaaatctatttcctcaacaaacgttttgcaatgatcaagaaggcattggccgacgataacaacgtcctcgaccgctccatctatgaagatgccctcttcaccaaagaaaacaacgctgaaggaaacatctctgatactgaattgaatgtttacttgcaactactagacaatatgatgaccgaattgactgaactgcctaagaaggcaccagacttgatggtctactctgaaactgacttcgatacgattctttaccggatcaagaagcgtggtcgcgactacgaacagttcgaccacaaccctgaactggaatcttattactataagatgtggaccgcttatcggaaatggtacgatgaatacgatgctagccctaaaatgaagattgatttacaacagtacgacttggaaaaacctgctaaccaacaagcagtattggcacaaatcgattctgaattaggtaagatccgcaaccccaccacagtttaatcaatgatgctaaaagcgccagccccgatagtgggactggcgcttttgctttgtacaatctgagtaacttcgagctgtcaaatgatcccggcagttttggctgtgaccctagtcacctgcgaatcgtcgcccggaaattttagcgactggccccgtcataactagcaaccttcgaataccacactagccagttacatcgccgctcggacttgttgcgctaactcaaagttgttggtaatcaccgcattgaccgaggccgcaaacaactgctgcatcacggccggctcatccaccgtccaaacccgttcagcgacgtggcgtacaggttgataatgctcaagatggaccccttctaagtgttcatgagtcgcaaactcatctggattacccagccgcgccgaggtcaaaaaagcatacttctggctggcatcaatggcgtaagcccgctgtaaactcttcaagttaaatgaggagaagacgaccggatagatcaagtcagtctgctggaccatccgtaagacaatccgttcaatatcaagataatagtgtcgatcagtcttcaactcaagattcaagtgaactggctccccactaactaaggtcaagaattcttgtaaggatggaaccggttcgccattggctaacttgaatctacgcaattgttcgaacgtcaggtccgcaatggcgccctgtccgttagtcgttcgatcaattcgttcatcatgcataatcaccggtacttggtccttagtaagatggacgtcaaactctaagccatcgatatgatgactgatagcatacgcaaacccggccaatgagttttcaggaaacttgacgggaacaccccgatgaccataaatcaacgacatatttggcacaattcttcaactctttccaattaatgacgaccgtttgcacggttatttgattctaacactttattgtacgtattttcagccgtttgcaacgattggcgaatatcttgcccagcaaagatttgctgcatggctgtttgaatcgctgtccgtgctggaacccagccatcgacaaagacacccgagttcgtattattcggcttagtacgcaacatctgattaccagaaacttctagcactggcgacttcttaaataacttcttcagggctggttcgtccttagcgcccttattaacggctaaataaccagtcttggcctgccagtcggcttgagtctgtgcgcttgcgagaaacttggtgaattcccacgtaccatcttggaccgcactgggcttatcgtttgcaatccatagtgctgccccaccaacagcgattccgttggctttctgcccattcggccgggggaagtacgtgacgcccaagtcattttttagcacttgatataactgccccgtttttgcggatgattgcataaaaatccccaaatgaccggctaagaatgaagctgcttcattggcagcggcgttaccacccgaaccaaagttcataaagtcgccatagtcaatattctctttgacccacttcatggcattgatggctgcgggactcgtgaaatcgaccttagttgcgttaccggtatgaccattatcatgattggcaacgggaacaccagcattagcgaccagctgctcgaataaccacgaataggcttccatggtcatccccttgactttgccatgtgacttgtcatgaatggccttagcgacgcgggtaatatcatcataggttggatccactggtggcggggtgatcccgtactgtcgcaagaccgctttattataataaagtgccgtttgcgacgcgttaaacggcatcgctaataattgattatcccgcatcacgatggctttggcacccggaataatctgatcagcatcgtaatgatcacgatcaatgaacttctgcatcggcgtcgtgaagccactatgatacatctgactagtggaaatatccatcgattgaaatagtgccggtgatgcggccgtgccgtgcgtgttcagaatcttttgaatgaccccgttatagccgccttcaaattcggcgacgacttcatacttcgactgttggtgattaaacgctttaacataggcgtcaatcgcttgttggcctggtcctttcatctcatgccagaagaccactttaatgcggctactatctgcatggacacgggtccgactataaaccacgccacccactaccatgaggacagccataatcccggctagccactgccactttcgcgttatcttcatcatttcaccgagccctcattcaatccagatttaaagtaatgttgcccccagaaaaggacgattaacgtcggaatcaccacgatggccgcactcgcctggacgagcccccaattcgtggccgtttcctccgaatgcaattgccgcaatccatcttggactggccgcagccgatttgaaaacgtggtcagcattggccataagtattggttccagctccctaaaaagctgtatgccgctaacgtcaacaaactgattcgtgagtatggcaaggcaacccgccggtaaaattgccagtgcgataggccttccacgtcagccgcctcctttaagtcccacggaatttgtcgaaaggcctggcggagcatgaagattccaaaggccgaagttaggaacggaataaccatcaccgcgtagtgatccaacaagtgcatggcacggacggtgtgaaagttcggaataacttcggcttcaaatggtagcatcatggttgccaagaccagataaaacaacgcatcccgatatttaaattccaaaaatacgaaggcatacgccgcgattgaggcgaagaacagatgcgccaccatttgaacgagtgaaattaccaagctattaaataagtagcggagaatcggcgttttggtgaacgcgtcctgataattttgccaagaaagggtaccactcagcgaccctttcgcaatggtcgttgtcggcaaaaagctggtccacagacctaaaatgaacggtaaaataataactaacgctaatgcaactaataacaggtatcgaagcccaatcgcgattcggtgacgaatcaaggcttgagtagccatcgtattttccattagtaatgcacccgctttgctaaaagtttgaattgaattaccgtgatggcggcaatgataatcgctaggataatcgactccgtactagcaagcgcgtagtttccatcaacgaaggcatcctgataaatccgataaactaataagttagtggcgttcgtgggtccccccgccgtcatcaagtcgatcagtccgaaactcttgaacgctgagatcaacgtaatcaccgccacaaagaagagtgttggtgaaatcatcggtaacgtgatatggaagaactgataacgacgactagtccccgcaacgtcagcggcatcatacaaggttttagggacagcttgtaatgccccaaaaaagattaaaaaggtgaagccaaggtgcatccagacactcgtcataataatcgccaccatggcccagtgcggttctgtcaaccaattaatagccggtaggtgcagccagacggcgaccttattcaacaagcccacggatggattaaacatgaatagccagaaaatagcagaaactgagacggaaacacccatggtcgaggtaaacatggtccgaaatagctcaattccccgaacccgttgattggcggtagcggctaacaataagcccccaatgattgtgaacaccgtcacgcccacgacgtaaatcccggtggcttgcagactagccagataactcttagtcgtcagtaaattgaggtaatttcggaagccaacaaagacggttggttcaccaaaactgttggtcaaaaagaagcttagatacaaggtccgtaacattggataaaaaacaaaaatactgagggcaagtagtgaaggcccaaggaataaccaagcatagtatttatcgttacgctttaattcaaaactggccgtctgggcattcgtttggccaggggtatccggagattgtttcggcttaaggcgtcgcttaatcgacggaaatgagttgatcactagtgacaccctcctcttcagcaatcagttgttcgtgctcgtcaaaaatgaagatcttaccgttgacagtcacagtcacccgctgttcaagtggcaattgaacttgaccggattgcacgattcgcaatgcagtcccgttatcggccagcacttcaataatcgtcatctcacccagcgtctcgacattcgttaccttgccattgccatgctcatctgcaactggtactgccttgagctgattaggccggataccgatcgtatagctaccagcgtttaatggctgattgagtgttatctgaaaacccgccgcaacgtgtaattcacgcgttgttttcgtcaccactggcagtaagttgatctgtggcgtaccgaagaattcagccacaaaatgattggctggatgattataaatatctaacggtgtatcaatttgctgcacgtggtgttcattcaacaccatcacgtgatcggccatggtcatggcttcagtctggtcatgggtgacataaatcaaggtcagtcccagcttacgttgcaactcacgaatttcagtccgcattcgtacgcgcaattgcgcatccaggttcgataacggttcatccatcagacaaatcttcgaatcactggcaattgcccgggccaaagccactcgctgacgttgaccaccggacagctcacgcggcttacggtcgcgataagcggtcaagttgaccatcttcaaggcgtcattgacccggcgttcaacttcgatagccggcatttttcgtgcttgtaaaccaaacgcaacgttagcagtcacgtccaaaaatgggtacaaggcataactctgaaaaaccatcgacagctttcgatcttttggtgggactgcattcatgatctgaccgttgatggccaactttccactcgtaattggaataataccagcaatcatccgcagcaaggtacttttaccacaaccggatggtccgacgatcacaaataactccccatcttgaatctcagcgttcacatcgtgtaaaactggctgttttgccttatcatacgtctttgtgatgttctgcaaagcaattcccatattcatatcccctcgaccttttatttgtaattccttggattacgctttaatcatgccagaccaacgtatcagaaacgttggcataatgtaaaaataacgtatgggttatgtatttttttcataaacaacgcctggctaacaaattcaggtgcaaactaaaaaagttgcttcgagaatatgggacattctcaaagcaactttttagtctggatcatgttagttaatccgtcatggatgatatggaatctcaatgcggccggcgcggtaaaaagtccgctagaattgtcccggcaaacaccagccgccgactcagagacagcaattaaagccaacgggtggtgtgctttggcaacttgaccggctgttgatcagcatccgtacgcaccaccaacgtgtcacaggttgcattacgaatcacataggcggcattggagccaatcaacacccgggccacgttgttaagtcccgtggcgccaaccacgatcaggtcggtgccataacggtctggtaaggtcgtcgctaatagcaacttcgaattacctgaatgcaggtgaacccgcacgtcgctaacaccggcggccatcgcttgttgacgggccttagcgagattcgctttaaggccggccgtcaactcgttcaatgcttgcggtgtcgttgcgccaaaacccatcggcccttgagtcacaccaataaatttctcagtattaatgaccgtcacaatatccaaagcggcgttttgctcgaccgcgatcttaattgctttcgttaaagctaattgggactgaggactcgtatcgatgccgactaaaatgcgtttaaccatcgtcataaccatcaccctccattaaaggatcactatttgtcggttgctaacacggcaattgactcagcgtaaatcgccattgcagccattaattcgtcaattggttggaattcattggcttgatgcattgtatcttcggtatctgggaagagtgccccaaaggccaccccacgagccatcatacggccataagtcccaccaccaacaatttgtggttgggaggccgtgtcaccagtttgacgccggtaaacgtccatcaaatccttgacgatcgggtcttcagggtcaacataatgtggcaccatgaaatcaccctgcgtgaccgtggcaccagctggtaactgtgcttggactttcgccgttaaatcagcaggttcgatgcccttcggataacggaagttcaacgttaacgcgccacccttttgatggtcgaagctgagtaacccgacattcatcgtcaaatcacccataacgtcatctttgtatgctaagcctaactggttcgcccgtgaatcatcgtgtagcttgttagccacgaagtccaagaaggccgcggcatcatccgcaaacgcatagttggtcaagaacgttgcgaggtaggttccggcgttgatgccgttacgtggttccatcccgtgagcagccttcccaacgacttccaacttaacgccttcaggaacgaccgttaattcaccggttaccggttgctgatccaagaacgcagtgaagtcggcggcaaactgctcgttgtcatccgtcgcgaccacggcttcagcatcacgcggcaccatattttcacgcaagccagaatcgaaggaaactagattaaagtcgccattgtcttcatgaccgaagtgtaattgtagactcacattccccttttcaccgttgatcagtgggaacatggcatctggagagaagcctaaggttggcgctggttcaacttcaaagtagcgtttcatgccagtccaattactttcctcatcggtcccaacgataaagcgaatcttcttattgagcttcaagccaagttctttgacgatctttaagccatagtaagcggccattccaggtcccttgtcatcagaaacaccgcgggcatacatcttgccgtccttgatggttggttcgaaggggtccgtatcccagccgttaccagcaggcatctcgtccacgtgggctaaaattgctaaggtctcatcgccctcaccaatttcggcatagccgaccaagttatcaatgttcttagtcttaaagccgtcgcgttccgcaatcgctaaaaacgtggttaatgcttgcttaggaccagggcctaagggtgcgtcatccgtcgcctggctatcgtcacgaaagctcgggacgcggagcatggtggttaaatctgctaaataatcatcttgatgcttagttgcttcatttttccaatcaactgacatgttaaattcctcccacatattgttaccttaattttatcatagctgtcgtcaacttaataatcgtaagtaaccgcttttagaaaatggtatactcaaagtaaattaacttagaaagctggtcattttatgcaacctattacaaccgagattgttagccgaacgattatcaaacggccggctgattctcacaaaggcaattacggccgggtcatgctgattgggggtaatcaaaactttggtggtgctatcatcatggccgcaacggccgcaacatatagtggtgccggtctggtaacggtcgctaccgacccgtctaacttcacgagtctacatgctcggctacccgaagccatggtcattgactatcaccaaacggacaccttattaaacctgctggcaggaatggacgttatcgtcatcggtccaggtcttggaacagataccggcgctgatcagttactgatcgccgttctcgccgcggcgcacgctccacaacgcctggtcatcgatggttcggcgctgaccctgcttgcgcagcaggcccggccccttcctgacacggacatcgtggtcacgccacaccaaatggaatggcaacgactcagcggcatcgcgatcaaagatcaaaccccaaccgccaaccatgacgcgcaacaacggttaggtgttacggccgtggtcaaagcgcatcgcacgaccgtttacactgacgaacgggtctggttcaaccccggtggcactccggccatggcgaccggcggcatgggtgacacgttagctggtatgattggtggcttcgtaagtcaatttcatgattttaccgatgccgtcctgagcgcggtctacttgcacagtgccattgccgatgacctcgctgcaacgcgatacgtcgtcttgccacatcaaatcagtacccgcattccgacttacatgcaccgctttagccaaattgaacggtcctaactagcttgaccatcactaacataaacaaactgatgacacaagcctaaagaaaagcctcaacaaaccatgctagaattcatggtttgttggggcttaataatttggttttaaaacagagtggccgaattcgtaacccgcactattcgccgacgggttggttcgcatccgccttcaacgctgtcagttcgtcatcagtcagcgcacgatagttccccgctaataagccaacgggtagcgttaacgaaccaaacttgattcgccgtaacccgacgacccgttcacctaacgttccgaccatccgcttaacttggtgatacttgccttcatgaatcatgattcgaatcgtggtaaagttctcgatttcatggaattgaacaatctcagcctgagccggttgcaattcagtcccatcctttaacgtgattccatcattaaaattagccaattgcgctgcggtgatttcccccgtgacttcagcctcgtagaccttcgtcacgtggtggttcggcgacaataggtcgtgtgagagggccccatcgttcgtaatgactaaaataccctcagtgtctttatcaagacgacccacgggaaataaatcgtcacgaaaatccgtggtattgaacagatccatcaccgttttcgcagcggaatccgttgtcgccgtgatgaccccaatcggtttgttcatcacataatagaagtattgttggtagcggacctgcacgtcatctaaaaaaacagtgtcactgccaggattgatctgttgtttgccagagattactggctcaccattggcggtgatatgaccatccttaatcagacgacgtacttgagtccgcgtgccaattcgcatcgcatgtaaaaatttatctactcgcataattcacctatttaatccgtaatttccgtcgtaacccagccgctttcgttccaatcatcaaatcagccatccgtgaacggagtgctaagtagacgtaaaccgcaccaccagcgataactgctagggcaacgatcaagaacgattgggtcttgctgtgctcattcaacacaaagttcagcccataaacaactaatcgtgccgtgacgtacgttaaaatcgaataaactaaaattcgattgatttttggtaataacttcacgtaccgaatgccaaagttgacttccagatcgtacattgccatcagacttgcaaccatcatcccaatcgcggtcgcaaccaggggccccgccgttgataggaaatagatacacggtaactgaatcacgattttgaccagtaaaccgatcaagtaatagcgaataatatcgcggttgcgtgataggccttgcatcagcgccgaaatcaccgtaaaaaagcctaaagcaatcgcggtaaatgctgagatctgcagaatcaacgttccaatttgatcataactataaaagagcgtgttaagtggttgtgccactgcggccatccccagcgctccgggaatcatgataaataggaataaaataatcgaatcttccaattgtttacgaatattacgcatattatgactggccaatgattcagataaaatcggcacgaccgtcacggcaatcgcagacgccaatgacacaatgatcatcaccaatttgttcgcattaaatgcaaagtaagcatacaacgtatcgatctgcttagtacccaaatggtaaaccagccgcatcatcggttggaacgttgcttgatccaacaggttgaagactgtcgtcgcggtatcgatcacaataaatggaatcgcctgaataataatatcgcggaacaattgccagactggaataactagtttgttctcactctgagcagctaaggcatttagctcgggccgtttgcggaaataataccaaccgagtaataagaagctggcagccgccccgacgaatgctgcgaatgtcgattgggtcacggcattcacccaatcgccgtgagcgacgcgcatgatgaaatacgtcgcacccaacatatagatgacccgaaagacttgttccacgaactgtgagattgcggacggcgccatctgttgatacccttggaagaatccccgggtcaaagacatcgatggcagaatcaccaaggcaatagccaacgcatgcaagacgggaatcagattggcatcatagcccccaaaagctgttgaaatcaagccagcaccaaaccataaaataatggcaccaataatcccaaaggctgacgtcaacaacaagccccgcttgaacaagcgctgtccaacggcatattcattcatcgcattatattcggaaagttgtttagaaattgcggacggaattcccccgatcgcaattagcaggaaaaaactataaatattatatcccttggcataaagcgcgttaccttgcgtataatcagcgcccatccagataacccacgggataatataaatcgccccgagcacccgtgaaaagagactcccagccgtcatccaagccgacccgcgcaccatcttctggtgcgcttcggcttcagaattcacgtgtgcattctggggctgattagcttttgattcctcagacatgttcgtaacccactttcttaattcaatcctaatcattttagatgaaaaacaaacaagttgcaattcaattccggccttatgcgtgagtttaaccgaactttaatgataaggtcttgacaactgcaccagctattggcgaaccgtaccgccgtccgataccctatggctgatacagaaaaaagaccaatccgtacgctttaccagcggccacgatgcggtctcaaattcgattacagcagagtgccgccatgataaccatttccgctgattaaaccacgttactgctagttttaagttaagcataggcggttgcacacgccctgcccaccaaaaacacgtgtgatttgtctcccaaaccgaaccagaacgtcctcagaatctttattcacttaaccaaatcaatcgtaaccgcactaattagttctgtgagtagttaaaaaatcgtgatagcaaccaacaattgtcagtcaccatcacgattaatttaagcgatattcatttaagttgatactggtcgtggtacttagttggcaaccacgttaaccagtttaccaggaatggcaatcactttacgaactgtcttgccggccgtaaattcctggattttttcatccgccagggctagtttttcaagttcatccttgcccatatccttagcgacttcggcgtgcgagcgaaccttaccattaacttgaagcacgatttggaccgtgtcttctactaacttagattcgtcatacgttggccaagtggcgtaggtgattgtgtcatcatggcctaataatgaccatagttcttccgacaaatgtggtgcaatcggtgacagtaacttcacaaagccttcgatataaatgattggtaaatcgtcgaccttgtatgcttcgtttacgaagaccatcatttgtgaaatcgcaatgttaaagcgcatagcttcatagtcttccgtgactttcttaacggtttcgttgtagattttcgtcaacttaccatcattgatagtcgtgattcggtcgcgaacacgattgttttcatcgatcattaagcgccaaacccgttcgatccacttattggcaccatgtaacccatcggtactccacggaatcgaagcttccaatggtcccatgaacatttcgtatagccgcaacgtatcggcaccatattggtcaacaatatcatcggggttaaccacgttcccccgcgacttagacatcttttcgtgattatcacccaaaatcatcccttggttaactaacttctggaatggttccttggttggcacaacgcctaagtcatataagaacttgtgccagaaacgtgcgtaaagcagatgtaagaccgcgtgttctgcaccgcccacgtataagtcaacgggtgaccagtacttcaacttgtcataatcggccaaagcttcacggttgtgcggatcaacgtaacgcaagaagtaccatgaactcccggcccattgtggcattgtgttggtttcacgcttccccttacgaccgttttcatcgacgacatttacccagtcgtcgatattcgctaacgggctttcaccagttcctgatggttccaggttcttagttgctggtaaccgcaatggtagttcatcttcaggaaccagcgtcgtttcgccgtcttcccagtgaataactggaatcggttcgccccagtaccgttgccgtgagaagatccaatcacgtaaccgatagttgaccttcttttcacccgcatggtgttcacctaaccagtcaatcatcttatcaatcgctggttgcttagctaaaccgtcaacaaaacctgagttgatgtgttccccgtcgccagtgtaagcttgttggtcataatcattatcacccgcaatgacaggtttgattggcaaatcaaatttttgtgcaaattcaaagtcccgatcatcatgagcaggcactgccatgatggccccagttccatatgaagccagaacgtaatcggcaatccagattggcagtttttcaccattaaccgggttgatgccgtagctaccagtgaagaccccggtcttgtccttattcaaatcagtccgttcaaggtctgacttgctggcgattttagctttgtatgctttgatagcgtccgcttgttcgggtgtcgtcaattgttcaactaagtcgtgttcaggtgccaagaccatgtaacttgcgccaaacagcgtgtctggccgcgttgagaacacttcaatctcggtatcgtcaggttgaccagcaaccttgaaacgaatggatgcgccaactgagcggccaatccagttacgttgttgctctttgatgttttctggccaatcaatatcgtccaggtcatcaatcaaccggtccgcataggccgtgattttgaggctccattgcttcattggcacccggtaaacgtcatagccaccgcgttccgtcttaccatcaaccacttcttcgttagaaacaaccgttccacccatcatatcaggagcccagttgaccaacgtttcagattcgtaagccaagcccttcttatagagctgttcaaagatccactgcgtccacttgtagtaacttggatcagtcgtattcacttcacggtcccagtcatatgagaaacctaatgaccgaatctgacgtttgaagttcttgatgttcttggccgtaaagtccttcgggttatgccccgtcttgagcgcatattgttcagcaggtaagccgaatgcgtcccaacccattggatgtaagacattgtacccttgcatccgcttgaaccgtgacataatatccgtggccgtatacccttcaggatgcccaacgtgtaatccttgaccagatgggtatgggaacatgtctaaggcgtaatacttcttcttatccgttgtgtctaatgttttgaaggttttgttttccttccaataatgttgccatttgcgttcaatgactttatggttgtatgccatagtagtgcccctttcttgctgccttgtatgtaaaagctagcattgcgactttccaactgactattcaagatggtcattttcatgcttcaactcagtaaaagcggttaaaaaacaaaaaaatcctataagccaattaagcttataggacgaaaacgggttccgcggtaccacctatgattccacgttaccgtggcctcttgggaatcttaacgcgaaaccacgtccgtacctacattcttgttcagccggaagactcgaaggtgagttcatgattggtgaatccccgtttgcaactaccacggagtttctgcaaaacaccagccactactattccttctcagagtcgtaaagttattgttttcatagtagcaaaccagcacgtttttttcaagggccccagccccgctggcgataaattttatcatcaggcattaatcggacacctgataaaaaatgctataataatggcaataatttatttatcggaggaatcagtattgaagcaacgatcctggcaacgttcggacagtttgatcctacttatatttataggatggttaggctggacggccgcggtatggcaacgggcgccttggttaatacactttgacactacggttgctaatttttggcatcatagtccccagtggtttcaacacgcgatggtcacgtacacgcagcttggcaatccccacaccatcaccataatcacgttgattattggtctggcactctggctgggtcataacccacgcggcgcagtcttcttttgggtcagcacctggctgattgccggctacggtaattatctcatcaaacaggtcatcatgcggccgcggccaactgcttggcggcttgtccaaattggggggtatagttaccccagcgggcactcgacaacaacgaccgtccttatcggtagcctgctcgtgttggcttttgactattggcaccgcaatgccctgactggctggctcactgccctcggcgtaacgtctatcttgctaatgatgattagccgggtcatcgtgggcgtccactatcctagcgatacaatcggtggccttttacttggaagtgttttactatatataagtgcgcgttttagtacgcgttatcggcacggaccgcttcgattgcggccttaattcatgaattcaacaagggggtaacactcattcaactcagttcggcattagcttatagccacgcgctgatgaaccaagtcgtcaatcccggtgatcacgtgattgacgcgacggtcggcaacggccatgataccgtctacctcgccaagctggtcggcacaactggtcacgttgacggattcgacattcaatcagcggccattgaagcgacgacaactgccttaaatcaagcagcgctcaaccatcaagtcacgctgtggcaaacgggccatgaacacatcgcagataagatcgccgctgatcaacctatcaagtgtgccgtcttcaacctgggctatctaccaggtggcgataagcaaatcattacgaaaccaacgacaacgttaacggccgtaaaagccatccaagaacgcctcgtcaccaacggcctcatcatcctgctagtctatgctggtcatcccggtggcgcgacagaagcacaagccgtattggattacgcaacgagtttggaccagcatcaatttcaagtcctgcaatatcaatttattaatcaagtccatgtgccaccatacttgttggccattcagaaacgttaatttaaccataaatgagcctaaaagacctgtcagacgattagcttcgtctgacaggtcttttcaattagatatttagcttaaaaaaactacttctcccacggatacttgccgttttcatccttaggtgtattacgcatgatccgcttagtgccctcatccatctctttatgccgtttcttacgattatggtgccgaacaattaggacaaggccaccgatgccacagtacacgatcattcgggtaaccatcttaacggtcccataaatggtcataatcattaacattttgcgtcctcccttaccgtcaaatctacttaagccgtgaccttagcaggcttaaagtaatctaacaatgcttgccactgtttgaaaacggcttcttctgaataacgcttggcattttcataagcctgagcactgtattgtgccagctgcgcttgattcttcaacaattccaaaatcgttttggtcaattgttgcacatcgccgtccgtcgttagaaccccactcttatgatcctgaataatatcactcgggccatacttcacgtcattggcaaccattggtaacccgtgggcttgagcttctagcaacatcaatgagaacccttcagctcgacttgacaaaagccctaattgggcccggttgtaaacggcattgacatccgtggtataccccttgaacaacaccacatcttccaagtgcgctgcggcaacttgtgcatgtagctgcttttcaatatccccgttcgcataaccccataattccaacttggcatcaggaaactgcttatgaacttcaacaaaggcttcaattgagtgattctgttgcttttcgggtgccagccgcgcaacttgcacgaccaggtctttttgtcgttggtcgaacttcaccggcgccgcttttaacgtagcatcatcaacatagccaaccggaatggtaaacgctggaatgtccttaccaaagcgagcttccacgtccttagattgttccggtgtagcagaaatgaccgcgtcccaagccgcccaattattcagcgcattagcataattattgttcaaggtagaatgcataatatccttagcatcactcacatggttattatgtagatgcaagactttcttagctggtgtggtcatattgaataagccccaggcacattcgacggtccgatcacaaatgaagacattttgttcatcattcaactggttaagttcatcatagaagtaacgggtcagttcattcatcccattaaaagtatggctctgctcgttgtagttcaagacgcgccacgtgattcgctcctgaccagcgtgatttaacaagtgtaacttctccacgtgaatcaatccatccgggccaaagtacgcttcttgggcaatcttaccgtcccagtcaaataattgttcaagacacttaaagccccgcgtatcccaccaactcatcttgagcgtacgaccattcacgtcaaaatattgcacattgctaacagcttccgtaccggcccgaaggtaaataatcatgattaacttaccacgttgcatgacttgaatctggttatctttccgcgtcttgatggcatcggctggcacttcaaagtctgctaaatcaaaccgttgacgcttgaccaactgactaccgcaaaagaagtcaaaaagattaacaaaattagcatcagcaatgttggccccttcaagtacatcgtgcaaattcattgcaaatacgcgggtcacgattttagcggccacatggtgcttcttgaataaagtcagtcggttgatttccgcctgttcgattcctgattttgaaaattgcatgttatcgtttaagaaataatacatatgcgccctcctacttaatacccagtaattgttgccaacggtgccaaacttttaagtcagtttgtgacgtatgaagcttcttaaaggcggcttcactgaatgccgtcaacttcttcgtatccgtcattaattcgatgacccggtcacgcagcgccaattgattgccaggatcaacgatgaaaccatcatgaccgtcatcaatccaatctttagggccataattaaagcgataactaatcactggaatcccgtgactcatggcttccggcatactcattggaccaccatcaacaatatcggtattgagcaacagctgataatcatcataacgtgtttctaaatcaggatgataatctaataaatgcacattattcgtgagttttaattcttcaatcagcttattcagcgtcttaagatactctggatcgccgtagccgtaaaaatcacactgaatttctttgacctgttgcttaactaacgcaatggtccgaattaactggtctagttgccgatccggcgccagccgcccaacgtatagcaattgcttagggcgggccgtgattggccgtagtttactctgtgccaacggactcgtcgtcacagttggtaacactgtcaccttagctttagggaaccgcgtccgcagatgctgggcctgactttccgtagctgtaataaagccatcaaagtgttgcaggttatcgaaagccggtgttaagaacccgtccaacggggaatgaattgggtcattaatatccttcgcctgataaattggaaccgtcacatacttgtgagaatcatcctgcagttccaataacggcttcacactggtacctgggcgatcactaatgaaggtcgtcgtttgcttgtccaaatgactgagttcggccaagaagaaatggaataagtggttcgcgtcctggaagaagcgctccgcttgatcgcggtaattctttaaaatcaaacgtgacgctagcggattaccattggtatcaggtacatagtactgctcaattacggtctcgccttgtagattataaaaacgttccaaaaccagtttcccgttctgaccaaaatattgggtactggacttgaaaccgcgccaatcccacaagtcggttgaagttaagttaccttgattatcgaagaattcttggtaaaagacacgcccaatcgttccaggaataaaaccgacgttgctaacgtgttcatcaccattaaaaattttgctaaagttggcacccacttctaccgcatattcaactggcagatgcatgtcatcagtatgcagaactttagttggcacatccgtggtttgttgaaagtaatcaaacatattcagcacttgctggttggccaactgaaaagttcccatggtctgatgtagtaagcggtcatacatcttagtcacaatctgggctggtgctttatagtggttaaataatttcacccggttgattgccgcgtgctcaacactcgaattcttgcctaaaatatattcattaatgaagtaaaacatacagtcaccctttctgttactcagcattacgcttgtcgatatgtgtagttataatagttcactaaaccggataagaaatgctcacaatcgtcaatccgtgtccggaagttgtcatgacgtgcatagaacccaccaataaacttctgcggattatagagatacattgcaatttcaggtagaaaacacccagtagtaatctcatacaacgcacggtaccgcaacacttgccgtaagcgagccaagtcataaggtgccatcaagtcttcattacctgaacgtttaatcatgtcggtcattttaacggccgcatcaactaattcaagcaatgttggatacgtggtatcacgctcttcaatgaattttagatgattgaatacatttttcaaacccagtttcatataatcgcgattgtctgggaataccagtaatgcttcattgattgcataagaaatccagtgatcatgatatttaccgtagtcattagccaccatgtaatccaagatttgcttcaccaggttcatcacattcttatcatgcgttaactcgtatagccgggaaagcgcaaatgcgacttctccctcataatagataattcgaaaagctgctttgaccgttaaatctgggttgagaacatgaattaacttgccagacggttcttggaagaaatggacgcctttaaagactttcattaaaactggcatgaaagtatcatccttggtgacgtcttgatatttacacaatgtaagcatcaataaggcctgcccacccaactttaattcgccgttatcgtcgacgaagattgcgtcctctttttcaatcgtggcattttttaagccccactgaatcgctaacttaacttttgcaaaatcttcagtgcgctttgtgaatggaatggcttccagtaatgcatataaggacgaaaagtgccggacaacgttgtaactgctaagaactctttgacgagcgggaaaataaccgtagacaaatttgccgttatccttcaactgattaatcaggaaggtttcaccatgctcaatagccgattgcaattcgctctgctcgtcagtcactacccgaatgcccttaccacaatcctcttgctcagatagattccagattttttgcccgtcagtaaatacaccagcggttgtaaagacccaaacattttctgtctgtcgaatatcgactggcagctctccttcacgtttattaagatacggcgctactcgatcatagtcgacccaagattccgaacaattcttaccaattcgatgcgctttgctaggacggaaaaatgcttgtccattactttccatttccaataaggctgtcttgaaatcagcatcaaaactaataccgtatcgccaatagttcatccgaaaagtagctgccaatcgcgcttcaaaagtcgctcgcggtaacttctgtgttgattgaactgcttctaatcgaacccaactcgcttgaggggtcttggctaattgttgtgcaactgctatccaagcttgcttgaaagaatcgtaacgatagaatcgcacttgggcccgatgtcgatgatccgataccgaaagtgccaaggttacggtacttgtaccgtaatctttcaaatttccagttgcaatcagtgcttgcttaagcttggtgacagtagatttttgcatcttagtcttacctctttcaattttcttttatgtacgccaaaacgggcttcacgcccgttttggttaatagtcttattttacaacgtatatcgttagcagtactaacaaatcagctttaaattttaactatttttgattctcatcatcttcatcatcatctttacgacgacgaccgaacaagaagaaccaccagccgagtccagcagctgcagccgcggtcaacaagccaccgaaaatcgttccggcattattacttgtatcagatgcagtcttaccattctcgtcagtattacttgagccgaccttatcatcagcactatcagtatcagctgacttcttatccttatcagaatcattactactcttcgaatctgaatcagtctgatcagaagttgcatcaacgtcttgagcgctagcagcggcataaaccactgatgtagcagcagttgctgacgttgttgcagcaccgtcactggatggtgtcgtaaccgccaacgttgcggctgtggccgagacaccacttgttgctgcagcactcaagctagtcgtacttgtcgaagcagcaccgttgttagaagcagtcgatgaagttgtcgtaccagtgccagtacctgaattatttccagtagagcccgtcgtattgcccgaacctgatccagtatttgaactggaacttccatctgagccagaattactaccattgtcagaattggttccatcatttgaatctgaatctgtgattgtatcggagtcactgtcgttattcgaatcactgtctgagtctgagtcgttgtcggaacctgagtcgctgtctgagtcagcgtcactgtcggaatccgagtcgctgtcggaatccgaatcactatcggaatccgagtcgctgtctgagtcggaatcactatctgagtccgagtcactgtcggaatctgaatcactatctgagtccgagtcactgtcggaatccgaatcgctgtctgagtctgagtcactgtcggaatccgaatcactatccgagtcggaatcactatcggaatccgagtcgctgtcggaatccgaatcgctatccgaatccgaatcactgtcagaatctgagtcgctgtcggaatccgaatcactatccgagtccgaatcgctgtccgagtccgaatcactgtccgagtccgaatcactgtcggaatccgaatcgctgtccgaatcggaatcactgtcagagtccgaatcgctgtccgagtccgaatcggagtcactatcggaatccgagtcactatccgagtccgaatcactgtcggaatccgaatcactatcagagtctgagtcactgtcggaatccgaatcactatcagagtccgaatcactatccgagtccgaatcggagtcactatcggaatcggaatcgctgtcggaatctgagtcactgtcgctatccgaatcactgtctgagtcgctgtcggaatctgagtcgctgtcggaatcagaatcactatcagagtccgaatcgctgtcggagtctgagtcgctgtcgctatccgaatcactgtccgaatcggaatcactatcagagtctgaatcgctgtcggaatcggaatcactgtcttagtcggaatcactatcggaatccgaatcgctgtcgctatccgaatcactgtctgagtcagaatcactatcagagtctgaatcgctgtcggaatcggaatcactgtctgagtcggaatcactatcggaatccgaatcgctgtcgctatccgaatcactgtctgagtcagaatcactatcagagtctgagtcactgtcggaatcggagtcgctatcagagtctgaatcactgtctgagtcagaatcactatcagagtctgagtcgctgtcagaatcggaatcgctgtcgctatctgagtcactgtccgagtctgagtcgctgtcgctatccgaatcactgtcagaatcggaatcgctatcagagtctgaatcgctgtcggaatcggagtcactatctgagtctgaatcgctgtcggagtctgagtcggaatcactgtcagaatcggaatcactatcagagtctgagtcactgtcactgtccgaatcggaatcactgtctgagtcggaatcggagtcggaatcggagtcgctatcagagtctgaatcactgtctgagtcggaatcgctgtcggaatccgaatcactatcggaatcggagtcgctatcggagtccgaatcactgtctgagtctgagtcactatcggaatcgctatcagagtctgaatcgctgtcgctatctgaatcactatcagagtccgaatcactgtcggaatctgagtcactgtcgctatccgaatcactgtctgagtccgaatcactatcggaatccgaatcactgtcggaatctgaatcactgtcgctatctgaatcgctgtcgctatccgaatcactgtcggaatccgagtcgctatcagagtcagaatcactatcggaatctgagtcactgtcggaatcgctgtcgctatccgaatcactgtctgagtcggaatcgctgtcgctatctgaatcactatccgaatcggaatcactgtcggaatccgagtcactatccgaatcggagtcgctgtcggaatccgaatcactatcagagtctgagtcactgtcggagtcggaatcgctgtcagaatcactatcggaatccgagtcactgtccgaatcggaatcactatcggaatccgaatcactatccgagtctgagtcactgtctgagtcagaatcactatccgagtcggagtcactgtcgctgtcagaatccgagtcactgtctgagtcggaatcactgtcagaatcagaatcactatccgagtcggagtcagaatcactgtctgagtctgagtcactgtcggaatctgagtcactgtcgctatccgaatcactgtctgagtccgagtcactgtctgagtctgaatcgctgtcagaatccgaatcactatcggagtcggaatcactatcggagtcggaatcactgtctgagtctgagtcactatccgaatctgaatcactatcggaatctgaatcactatccgagtcagaatcggagtcactgtcagaatcggagtcactgtcgctatccgaatctgagtcgctgtccgagtcagaatcgctatcagagtcggaatcactgtctgaatccgaatcgctgtcagaatcggagtcgctgtccgagtctgagtcactgtcggagtcagaatcggaatcgctgtccgagtccgaatcggaatcactgtcagaatccgagtcactatccgagtcggaatcactgtcagaatccgagtcgctgtccgagtccgaatcactgtctgagtctgaatcgctgtccgagtcggagtcactgtcactatcagaatcagaatcactgtcggagtcggaatcactatccgaatccgagtcgctgtccgagtccgaatcactgtctgaatccgaatcactatcagagtctgagtcactgtcggaatcgctatccgaatccgaatcactgtccgaatccgagtctgaatcgctgtcggaatctgagtcactgtcgctatccgaatcactgtcggagtccgaatcactgtcggaatctgaatcgctgtccgagtctgaatcgctatcggaatccgagtcgctgtccgagtccgaatcactatcagagtctgagtcactgtcgctatccgaatcactgtctgaatcggaatcgctgtccgagtctgaatcactatccgaatccgagtcgctgtccgagtccgaatcactatccgaatccgagtcgctgtccgagtctgaatcactatcggaatccgaatcgctgtccgagtccgaatcactgtcggaatccgaatcactatcggagtcggagtcactgtcgctatccgaatcactgtcggaatcggagtcgctgtcggaatccgaatcactgtcggaatctgagtcgctatcggagtccgaatcactatcagagtctgagtcactgtctgaatccgaatcactgtccgaatctgagtcactgtcgctgtccgaatcactatcggaatctgagtcactatcggagtctgaatcactatcggaatccgaatcgctgtctgagtctgaatcactgtcagaatcggaatcactatcggaatccgaatcgctgtcggagtccgaatcactgtctgaatcggaatcactatcggagtcggagtcactgtcgctatccgaatcactgtcggagtcagaatcactgtcggaatcggagtcgctgtccgagtccgaatcactgtcggagtccgaatcgctgtccgagtcagaatcactgtcggaatcggagtcgctatcggagtcggaatcactgtcggaatcggagtcgctatcagagtcggaatcactgtcagaatcggagtcgctatccgaatcggaatcactatcggaatccgaatcgctgtccgaatcggaatcactgtccgagtcggaatcactatccgagtcagaatcactatccgagtcagaatcactatccgagtcagaatcactatccgagtcagaatcactatccgagtcagaatcactgtccgaatctgagtcactgtcgctatccgaatcactgtcggagtcggagtcactgtcgctatctgaatcactgtcggagtcactatccgaatccgagtcgctgtccgagtccgaatcgctgtcggagtcagaatcgctgtcggagtccgaatcactatccgagtctgagtcactgtctgaatccgaatcactatccgaatccgagtcactgtcggagtcggaatcactgtcggagtcggaatcactgtccgaatctgagtcactgtcgctgtccgaatcactatcggaatctgagtcactatccgagtcggaatcactgtcgctatctgaatcactgtccgagtcggaatcactatcggaatctgagtcactgtcagagtcggaatcactgtcggaatctgagtcactatcgctatccgagtcggaatcactgtcgctatctgaatcgctgtccgagtccgagtcactgtcagaatcggagtcggaatcactgtcggagtcggagtcgctgtccgagtccgagtcgctatcggaatccgaatcactgtcagagtccgaatcactgtcggaatcggagtcgctgtcactatccgaatcactatcagaatccgagtcactgtcggaatccgaatcactatcagaatccgaatcactatcagaatccgagtcgctgtctgagtcagaatcactgtcggaatccgaatcactgtcagagtccgaatcactgtcgctatccgaatcactgtcgccgtcagaatcactatccgagtcatcttcactaacattagcagctaaatcagcatagtagcctgcatcatcagcggcacttgaagctttctttttagcttcagatgcttcggacgctttctttttagcttcctctgcataactggaagcagccgagttttcgccggcagcttccgcagaatctgcatttgattgggcggctgccgcattagaagctgcagttgaagcagctgttgcagctgactgtgcatcagaagctgctgccgttgcttgttctgcgtaggagcttgcttctgagtttttacttgcatattcgcccgcaatgttcgcataagaactagcaactgaaccatattccgtcgcttgatttgcgtagttagctgcttcgctagctgcagaatctgccgcttcagttgaaacagcattaacagtcaagtaagcccggcctaaagttacagttgtcgtggtagtagtcccgttagtcgtattggatccagtaataactaggtagtaataaccggattgccctactgtcagatccgacagattaagtgtcgtaccagtctgaccactcagcgctgttccagtaccgtccgctgttgaagaataataccattgataagtaatattagtcccagtacccgtagtcgagccatctggaacccacgtcaaatcacttcctgcatcagcagttgtatcctcaaggccactaccaattgtaattgtctttgaagatgaatagctagttccgtcagcatttgtaattgttgctgtgattgtcaccgttccattagacacaacggtcaaaaggccagaatcatcaattgtcgcaatgcttgaatcacttgtcgtccaggtaatcgttccagtagcattctcagggttagtcgttgatgtaaactggctagtaaccttatcgtttgagccacttgaactgttcgttggattaatgacgtaatcatcaccagctatggaaatgtttgttgctggaatattgctactataaacatcgacttcagctaaattacttgcaaatgtataaactgtaacccagtttaacaagtcccaagaaaacccttgtacggcttggaacagcaatgatccagtatagcccgctttgatagtaactgttaatgaactactagttgacagtaaaccagcactgtcaaccggattatatgattcaatataagcgccagccttatctaaggtcatccaggtgccgttaacttgaacataccaagttgtttttgatgatagtgcaaccccacctagtcctaatgctgacgaagctgacaaggtaaaggtcccaccagaaacggtcgacgtcactgctgcgggttgagaagtcatcccaccagaaataacaatccctagaattgtcgttgcattacccgtattagtgcttttatatgaattcgtattgtttgaataattcgtcgcgttactagccgccgtactacctaaagccgcattggatgtagacaatgccgcatatgaggttgcttcactggctgccgctgaggcattagtcacatatgagctggccatagcataatcgcccgcagctactgccgatgaagcctggcttgtatactgagctgccatttccgcagctgaagttgcggccgccgctgcacccagagttgtcacggcataattattagtttgtgcaacgtatgagctacccaacgtagtgtttgacgcatactttgcacttaatgaactcgcgacactgattgcgttcccggctgctgatgcagctgctgacgctgcgctagaggcagccgttgcaatcgaattataataactggattgtgcttgcacgaccgtttgggtaatcgcacttgccgcactcgaagcagcattcaattgatccgttgcgtaggtcaaacgcaaagccgcgtagctttgttgcaaggcagccgaattataattcccgtccgctgcatatgaagcagcaaggcttgccgcttcactagctgccgctgcgtatgaactagccgctacagccgcagaacttgccgctgcattataactgctagttgcagcggtattaaatgaagaaccagcaacgttatacgcattagcagcgttggccgcataggatgcagccagtgaggcttggttactggccacatttgccgatgacgcagccatactagcatagcttgatgctaaataatcagcggcagtatcaccgccatcttcattgaccgcattcttcaaagcagtatccagactagctgctgcctcagatgcggcactacttgcagagctggcatattgagtcgcagcacccgcgtaactcgatgccagacccgcccagatattagcgctagtatacgccccttcggcttcataagaagccgccgaagtactggccatagctgcaatacttgctgcttctgaggccacactggcgcatgagctcgcaacgttgtatgaagaattagcctgtgacgtgtagtaactagctaatgagcccgtcaagttagctgaagagctagccaagctgattgcactacttgcagcagcggcttgagaggctgccactgaggctgcactattggcttgactggcataactgctggcaatttcagtgtaagttccttctggattagtgacaacaatggtaatcacattaccagctgctttatagcttgaaaaaacagtagatcctgacgctacgacctgataatagtacgtgccagaaattgttggtgttgtcgaatatgttgccgaagttgcacctgaaatcgtggtccaagtagtcccatccgtagagacataccaagtatacgtggtcgatcccaaagctacaccactgatacttgtcgaattagtaatactaatcgtactacccacagacacactaggcgtggttgtggatgtcgttacggttgcgttcttgctgtcggtttgttcattagcgacatccgtcgagaacttagcagctaaagtcgcgttagactcggcagttgcagcgtaactagcagccaatgaagatgccgattgggccacccgagcgtatgagtccgcggtggcaggatcactagcactgacagcggattttgcggccgtacttgcgacggcgtaggctgacgaagcagaactagcggccgttgcagcacttgaagcataagctgaggcttgagtaccagtttgcgttgctgccacactggccgcacttgaagccgtactctttgacgtattcgccacgtttgcacttgaagaagccgcgctcgccaaatcgctaattgcagtactattggcaaaactggctgccgaactagccgtgctagtagctgtgctcccggcggcatattgaccaagcgcctccgttgcggcggaggaagtaactgcataggcagtactagtggcttcatagtcattatttgccgcattactacttaccgcggcataggctgaggaagctgccaccgcagcggtcgttgcgttaactgcggccgttgaagccgcagctgccgtgctagaagcgacggcgtaagctgaggtaacggccgtattatttttatcgtattgcatggctaagtaagcactgttggctgcttcagctgccgagctagctgctaccgtggctgcagatgccgcactggatgcggcggaataattgctacttgctaaattaattaagccttgggtagcagcgctgctggccgttgaagtggccgttgaagccagggctgcgtatgaactggccgcactggccgcactaaatgctaaggagttggcattagtgtatgccaatgtattatctatattcgaccccacaccagtgttcagtgcctttaagtacatgtttgcgatactattgtagtgccgtgacaaatcagccgcgttgagcgcttcttgataggcactttgggccgcacttactgcagcttgcgtcgttaggttattgaccaaactagcatagctgctggcaagtgtagcgtatgaaccagctaacaaagctgacgatgatgccgccttagctgcggtactatcggtatatgaactatcccccgattccgacgagtaagctgcaatggctgccgttgaagccgccgtactggcagacttagtcgtgctggcagcactgcttgctgtcgagacagtacttgccgctacgctagcactgcttgacaaactcgtcgtacttgagctagctgcggaagaactgctgctatcagttaagctcgatgaagtagcgcttgacgagctcgaactactacttgaacttgcgctggatgcgctcgaactagccgttgaaacactactactagtacttgatgtacttgtcgcattagtcgtacttgtttcgctcgcagaacttgcgtctgaagcactgtcatcgctgcttgagctatccgatgaagattcgtaattactgttcaaggcagtttcactcgaagaagatgccgtagacgagtcactggtagtactagttgacgtactacttgccgttgcagcagctagtgccgccgcactcgctgctgcagaagacgtatccgcccccgagctggcactactagtggcactacttgctgtatcactactagtatccgcagaaaccgtatccgcatgagataccagctgaggtgcagcagtcaatacaaatgatgccatcgccgtaaatacccaagtacggccgactttaaacatcttgtagtgaacttgcggatctcccctaaaagatttatgtctcagaaatttcatggttttgccttccttctctaacctaatcaaacccgtttatatatgatacaaaaaacacatatatagcatcattggtataccccatcaatcgttagactatgcactcataatactatgattatgttttgttggcaatagttgataccgtcaatcttgttacacgttttccattaattttcctaaaatagttaccaaataaataatattaatgaaaacgagtgtaataggcctcataaagcccattacactcgtctaacaacttaaaatttatttatagcacttatggaaattttattgaaaatttttcagatttttttacgttaatatcaaataaacgacaaattatgagtcgctttgacaattaatttgttgatactaagccaactaatcctgattttggtttaaatcagccgcgtgttgtgctgccgttttttgtggtccgcgatccaaactattcacaataaaggctagaataaccaaaccaaggccaatcaggtagacccaatgtaagcccgtatataagatacgatgaagtgtcggcaacaaatgagacggtaattgcgttgcggtctgtggattgatcaacttgttcatcatcgccatgttcgttcctgcatggtgctgaataccttggttcatcccaacgttcaacgcaattccaaagattgaaatcatcaacgtttggccaatcgttcgactcagcgtattgaaggacgttgcgacgcccacgttctcagctggcacaaggtgttgcgacgtgacggtcgttgctgtaattgtaattccgaagcccacgccaccaatcgctgtaatcaggaagaaccatgggaaagcagtattaactggcaaccacgctaagcagatgcttgtcacgaggatgaaagccaaactcagatacaaaatccgtcgtggcgcccactttgccaataaccgccccgtcacgaatgacccgacgatccacattaacgagctcggtgtcactgcaaatcccgccaaagaagccggtacacccagtatcccctgagtccaagttggaatataaacttcaacggccattaggaagccactgactaaggccgccacggcattctgaataataaacgtgtggtttttgaataaatccatcgaaatcactggttcatccgtgcgactttcacgacgaataaatagccacaagctgagcgcactaatgagccaagcgatcccaacggccacccaactgatagtggcgtttcccaataattggaagcttagcatcaagcacagcaagaagagcatcagccaaaagctacccaagtagtcgattttcacgttattgtgacgtttgggttctcgtaaataaaattgaaataggaaaagggtgattaacccaactggcacattaatgaagaaaatccaatgccagctgagcttatcgacaattagtccaccaatcagcggtgccagcactgaagcaatgccccacgctgaactattgaagcctagcactttggcccggcgctcgaatgaataaatatctgcgataattgtcattgagactggcattagcgccccggcaccaatcccctgaatggcccgccaaaaaattagcaccggcatcgaattagacaaaccgctcatcatagacccgataataaaaataattagtccggcttgcatcactggttttcggccgaccaagtcagttagctttccataaattggcgtcatcatcgcattagtcaataaataaattgagaaaacccaattcatcaatgaaaccccgtgtaaatcaccaacaatcgttggcaaggcggtcgacacgatcgtcccttcaatcgcactcataaacgtcgcgacgtaaatggcaaccgtaaccgccattacgttagttttacgctgttgcatcttagcaattctccttctctatcaatcattttaaaaccccgtgcctctaaaatagcccgcaaaaaaagcgaccttgaaaaaaggtcgcttttagcgtcgagtacctacagaccgtaacgaatcaacgttaccgcattatttaaatgctgcttttaaagcatctactttatcagtatgttcccatggtaaatcaatatcggtccgaccaaagtggccgtatgccgcagtttgctgatagattggccgttgcaagtcaagcattttgataatcccagccggacgtaagtcaaaattgtcgcgaatggcgttaatcaacgcttcatcactaaccttcccggtcccggcagtatccactgcaatcgaaactggttcggcaaccccgatagcatatgccaattgcacttcaacctgatcagccaagccggcagccaccacgtttttggcaatgtaacgagcagcgtaacttgcagaacggtcaaccttggtcgcgtccttacctgaaaaggcaccaccaccatgatgggcaaaaccaccgtacgtatccacgatgactttccgaccagtcaaaccggcatccccttgagggccaccaataacaaaacgaccagttgggttcacaagatacttggtttggtcatctaacaagtcagctggtaacacggccttgatgacttgatcaatgaccgtttgccggattgtgtccaaatcaacatcaggatcatgttgagtagacaagaccaccgtatcgattcgcttaggttggttgtcttcgtcatattcgaccgtgacttgggccttcgcatctggacgtaaccacttaatggtaccatccttacgtagcgctgcaattttacgcatcaaccggtggctcaatgcgatcggcagtggcattaattcaggggtttcgttgatggcataaccaaacatcatcccttgatcaccagcaccgatttgatctaatgggtcagcatcgccagaacgcgtctccaaggaatcatcgaccccttgcgcgatatctggtgattgttcatccaatgagacaaggacggcacagttgtcaccgtcaaagccgtattgaccatcaacatagccaatcgacttgatcgtgtcacgcacgaccttttgaatatcaacgtaggccttggtcgaaacttcaccgaagaccagcactaatccagtcgtcactgaggtttcaacagcgacccgtgcttgtggatcctgggctaacattgcgtccaggatagcgtcactgatttggtcagcaatcttatcaggatgaccttcagagacagattcagatgtaaataagtgtctttcactcacaataaattcccccttgataatttcggttacaaggcatctaagcatcacttattcttcattgaacaagttaaacttatcctttcgggaacggctcataactatataaggttatcacaatcaccattttttttaaagatttctgtcaaattattgacgggaactgccccgaccggtacgattaactcattatcctaattagagagtgttgacaatatgattcgaatcggaaaattacatattaaacgcgattacatcgccttggcgatctttaccatcgttcaaagcatcattagttggtgggccgccctagattacgggcgctcatttcaaacggcctcattttcagccgcgcagttaccactgattggctacaccttagccgtggccgccgcggtcttcattatcttagatcggcggattgccccccagtggagcctcattgcgattggaattaccgtggcctttgcatttaccaacattattgccaaggaatccgcattattatacctgctattaacgtgcagtgcgtggttgctcgtgatggccgttccacgcttcggtatgcaaaactacttcggcttagtcgttttcagcgtcatcatgacgttcaccattccggtggccgttttcgacttacaaaacaactatttatcaacaacatttctctggaagctgacccccatgctggctagttatgtcttcctatacgtaccgagcttcagccgtcaacgccaaatcaatcaactgatttcggccatcaccggtctgctacttgttatcaccatcttcctgcagccgctgacctggcaaacgatcgttgcaattctcatcacgattgctgtttggttcagtcaacagtcctttggccgtactcggttgcatcttatgatcaacgtagccgttcagttgatactgattttattactttattaatatctagataacaaacaaggcgtctacctagtctcttaaactaggtagacgccttgtttgtccctatcaccagcttttaaagtgctgctattaactggcgccacttttcaataatcgtctgcttgctgtaacgagtggccgaattgtaggcattcgtaatcagttgtgcttgtcgttcagggtgctgtaaatactgacgaactttcattgtcaactcatcaacatcattgggtgtcactaggtacccgttcacgccgtcttcgataatatcttccggtccgtacgcaattcgatagccgataactggcacgccatagctttcggcttccattgtggctagcgaaaaaccctcttccacactcgtcattaaggccaagcttgcccgctgatactcttctgccagattgggtaagaaaccccgaataacgatatttttttctagatgattggcctgaataaattgacgcatttgcgcttcgatcttttgcccatgcccaaacaactgcaaggtcaggtcgggaaattcaccaactaaccgccgaaccacttccagttgatgtggtaattgcttttccggtgaatagcgcgccacactaataatccggtgcgggtcacgaccatcaattttaaccggatgaaccgttgtatagccgactggaatcacgacaactggtggtaaattatcatagcgtgccaataaatcacgcttctgatgctcggtcgacacaacaattcggtgaaattggtctggatgggctaggacataccgatagaccgatttcaaatgcccacttaccacgtcctcaccaatccgtagatgcgtgctatgtaagactgaacatacgcgaattgcggggcgcgtatgacctaaggccgccgccgtttgtcggttacgatcacagaaatagacgtcatcagcagtggccaactcattgaagaagaatgtctgaaaagcctgttcggtattgaagaaaaagtctctttgttgatagttcttcaacgtaatcagtcgtagttttgactctggtccggtaatatcatactgtttgataatcttgacttgcccttgtaaatcataatacacttctgtgtgcacttcctgatgtttcactaaaaagcttgtccggctcaggaagccccggttatcataaaattcgcgtcggactttaacaccctgattatcaaaataattgacataatccaattgttgtcgcccggcgtccacaaaatgaacgtacatcaaatattgaccatcggtatccaggacgcgaaaatccgtcgtatttggaacctgaatcaccttaaagtgacaaacagcttgccaatagtgcatccaatcatgatggattttagtcactgcttcagtcatcgtcccctgaaagaaatcatacaaactaaagcattttccttccgcaccaaagcgggccgcatgctcatgtaaacgcggattataagtgacatagacgcatcgagcctgataaccagcggcgtcaaatagcgccagtcggttcaactgtgccttttcaattcccgtcaatttcaatcctaaaccggtacccacaaaataatacatcacctagccgttcccttctcaatctgaaaaatcaactcatcctgtcaccgagttcaaaaacttcgagtacgcacggacgattgaccacttcatctgttatatctatacactatctttaccctaccatattttacgttactcgaccaagatatgaacagttttattgacatactcaaaaaatggcacgttttaatcatgattcataacagtttaactagtacaataggaattactaaatattcatgacacattttaaaggaggcactatgtcacaatttgaaaagtatcatcccattctgacgccgcactatacgtttgattggctaacaaaggtgcgcgttatcgacgttttcaacttgtatcagaccagcaatgcgacggccactatggaaacaaccgctgcacaaattaaccacactatgcgtgagatttttcatgaccaccagcttgtttggggcgtaacggatcgagacacgaacgcgttcgtcggtcaggtcggctttgccccaatcgatacggctaagcatgaagcaactctcagtgttgacctgactgctacttatcagcaagtaactacgctcagggaaatcttagaacggttggtggcatttggtaccgttgagttaaagctaaaccgcctcacattgattttaccaaagcgcgatgacctaatggcacaaatactggctggccttaactttagtaccaccgaccacttaacattcaattatcaccaataaacaaataacgcgatgctaccttcatgaagcaaggtaagcatcgcgttattttaacttattattcagtgacagcttcggccgcatgggcaatcgctgcttgaccaagtaagttcaaatagttaaatggccggtcgtaaattggttggaagaacatatctacgaaccctaagtcgtcaatggtattgtgattttgaatcatcactgaaatcacattggctgattgcgaaacatcatgttcactcatgaattgtgcacctaggatttcgcgagtttcaggattgtaaaccaattgcattaaaacaggcttagtggttggcataaattctggccggtagttgtcttcaaaagtgacagcggctgccggaacattttcggcctgtgcatgttctagggtcatcccagatgaaacgatggtttggccgaacaacattaacccagaagttgattgtgtccccatgtacttccgcgttggcttgaagatgttcaaaccaactaaggttccttggcgaaccgcattcgttgctaatgggatataagcatctttcttagttgggttatagtgaacagcaaccgagtcgccagccccgtaaatgtctggatcagaagtttgcatgtagtcattggtcttgatcgagccattagcgttcatatcgaccttgcccttgagtaagccggtatttggccggaagccaacacaaagaatcgccatgtcggctgtgtagctgcccttgtcagtcttgaccgtaacttctttaccatcatcactgaagccttgcaccatttgattcaaagccatcttgataccgtgatcaacaaagtcttgttcaacccggtcagtgaattctttgtctaagtatttatttaaaatccgtggtaaaccatcaattagtgtgacttccttaccttgcttctggtaagcttcaactaattcagtaccgatataaccgccaccgatcacaatgacccgcttagctggtttggctgcttcccataaattctgagcgtgcgtccagttcttgcataagtagacattgggactatcgatgccgtcaattggtggaataacaggccatgaaccagtagtgacaactaacttgtcatagtgatcagtcttagatttaccagtctttaagtcagtaaccgtgatttcatgtttgtcagtattcacatccgtcacgtcatgttgcatatgaacagttgcgcctaacttagctaactgttcaggactggaataaaatagaccttgaggatcagcgacttggccgccaaggtaaagtgcgatcccacaggataggaacgagacattgtcatttctttcataaatcgtcacttcagtatcgggatttgatgctaaaatctgattaacggcagcggtgccggcatgggtacaaccaattacaataactttcatttttaaatcgctccttaaatgtgtttatattcacaatcatgcttgtgcaacatgtatttggtaacaattacattgtactaaagtaaaaagaaaacgcaaccaaaaacacgtaaaaagtgtaaacacttcactaatcacacgataaacaaatgcctcgattacaacgttctcagtcattaaggctgattattcattcacttaactgtggtaattaaaattattattatctttaaccattatggctaataactagaaagcaaaagcactcacaatctcgctcgtgagtgcttttacttctcttattccgaccctattaattacttaggtgcatccgtcaatgtccacgtaatgtcacccgtgtaagatcctggtgttgccccggcattactttgatataaaatgcctgacttattcgtccagtctgccaagacatcataatcatcgttatcactagtagccgtgtgactgtcaatcaccgtaccagcagaattcagcgtggtcgtctgctcgccgtcacgaaaaatcacgtcgcccgccaaattctgaccaccggttgttttaaaattagtcgcactagcttgtagttgccaactagagcccttaccacgactatcccgcaccactagttgccaatcgtcttcccggtctgtcgtttgagctgaaccatctaaagtaatggttttaaacgtgctacttttggcaaccgtcttaaaaccaagttcacctgcagtaacaataatctgcgctttatcaactggtgagacgttctcgtaacggtcagatgcccatagttcaatctcattgtcatcaccgacgtgtaaatcctctgctttgaccttgtagtagaagtaaccttgttcgtcatcatccgacatttgaaccgttggcatttccttgccattaagcgttgggtgtagtgtcacttgaccgttagttaattgttccgaatcctcggccgcaacaatccctctgatgatcacgtcttccccattggcgacagtatacggactattacgaattttaaggtatagcggctgatcgactgtaatcatgtaatccggtgcttccgtcgttgtttcaaacaccttatttttaaatgtcgccgtcgttgcagttgtctgttcattgacaacgacattctcggccgtcccattgagcgtgatcgtcgcggtcggttggctcaccgatactgctttatctagtgtatagtcaaccttagtatcactactcgttggcgccgtcaaagcctgatcactaccatccgcatacgttaccttggcactgtcaaacgcaatatgttgcggtagattgagttcagccgtaatgttatcccagtcaatttgaccgccttggtacgtcaattgatagtcatactgaactttatgtttggctttgagctggccacccatcttgatttcgcgattcttggtcttatccgtaaccttaaccgccgcctgcacatcaactaagttcggcgcactttcgatcacgaccatgttgttaccagaattactaccagtggcgcccatgaatccccagcgaaccaggccatcactactgttgaattggctagtatctaacacttcactctgagtaaagccgctacccgtcgccgacccatctggattgatgtcattataagtgtacgtcatcgttttagtcgccgcatgccagtccatcaccaggtggtgccacttgctatctcctaatgacatattcgtcactaggttggtatgtttttgcgtaaagtagtaccgggttgaccaaattatcccggtaacgtctaaactcctgacagactgattttcatactgactagccagcccaggatacccggtcgcaatgtgttgtttcttaataccatcatcaaacgaatcacccttaccagcattactatagctagttgaagtattggtataggtatcaaactctaaggcccaactattttggatggccgttttcgcaaattcttcgccgtccttcaatttattatccgtatcaacaccccaaacaccgagtgtctcaccaataatgctggacgaactgacttgtgcggatgcggcagtaccatttggatcattttgtaagacaaaagccatcccatcgccggccttactagtactcgtggatgttcccaaatacacccacattttaaacgtagcatctttatttaaatctaggcgattggcgtcgttcgaccaaaagccacccatttgcttcttgccgttaataacctgaacggcctgcgtatttggcgagcttgcattggtcacattcccaatattcgcactattactaatgccactactgaatgctgctggtagcgtaaagagtttatccaactgattcaggccagacggtgccgttgccaacgtcgcttcgtcagcagcctgaatttgggcggtcccggcccataatcccattaatgcagttaatgcaactagtatttgtttcggtcccttccacatgttgaaaactcctctcgctagttagtcctgacgacggcggtttttcaatagtagccagataattgcgcctaataggacaataatcagtgcgcccaacgcaacaaaccaccagaaatagttcgattgtttttctgtaacagctgtatcatttaaagtctgagcttctttatcagtaatggtaaagttctttgtaaattgccacttacccttatcagccgttgccgttaaatgtaaagtgtacttgcccgccttcaattgttgcgtcccgtcaccaactgcaaagtcaaaattactatttggcgccattgacatattttccttagtcgtcgtcaataatttcttagatgaacctgccttagtcacatagctcttgatctttaagccatgcataataacgggctggttgttttgcagattagccgtgacgtaattacgatagttacgttgcttggctttgaccgcgtgcaacttcatgacgggtttgatcgcacttggatcagtttcacgtaactgcaagccaatcacgtacgcatattgattattgatggccataccactactagattgcttcgccttggtactgagttcctggatgatattgataccacccagcgccacgcccgcaaactttttctcgggtaccgtcaatttaatagtgacttttttgcttgacttagcgggaacggtcacgacctgtgactttgaaagtgctgtcttgatattaaacttcaaggaatcatcggccttggcttttgcctggctataatcgatgataccgttgttattcgtgaccgccagattaggcgataccgtgtatcgatgttctttactatcactatttttaatggttaagttgagatcctgtgtttgccctggtgtgacctttaagtcaaaataggacactttttgattaatttggttatcaggcaaatccgcctgaaccgtgtaattgaggtcatccgctcgagcagtcattgtcaaacctgccataacgagacccacaacagcgattaactgccaaaatatttttttcataggctttacccttcctttattcaacggtaagtgacgagctatgtatgactgaagctgccattcgttacaagtagcagcttcacatcaaatcatttaattaactaggtgcgttcgttaatgaccaagccagcgtacccgtgtagtcgccggcacgcaattggcgatcatggacttcgagttccgtgggtacctgcccgcgattcagaacgaccagccaagtacctagaccagtattaggcggggcaatcacgacattattcgctaaaccagcaactaattcaccagtattaacaacgttaggtgtagtactaacattgccggcaccgggccgtaattgaactgcacctaattttaaagacgtcgttaaggtctgctgaccactttgcaataagcttggcgtgacctgtaacgtccacccagcagccgtggcgcggcgatcagttatttgaatcatcgcccgctcattcttggcagtcgtcttaatcggcccacccgcggtcgtaatcgcattgaatttcaaattactgacgaaatcaatggttaactttccccgtgagcccgtaccagcgacattgccttcatcgaccggatcacccgggtatggtttactaggatcatcagggtcgaccggagaaactgcattgtcatcatccgaaggggtcatttctacctgcacctgtgactgtgtcgttgcagcttgcgttgcgataaaccagccccagttactaatgatgagacaacctatcacagtcattaataaccgacctgttaccaacaatccctttttcatcggtcacacctcagttctcctctggcacattaactggttagctaggggcgttacctaatgtccatgtcaaggttgaagtgtaagcgccagccgcgttaccagcagggatcaataggctaacttcattggtcgcatacttactcgtaaacttaccgattccttcattagcttctgcgtccatgataatttgatcttggtcagtgatagccactttataagcttttgctttagagatgttattagcatcatccgccgttgcattaacttgtgcaaaagttaacgcggcgccccgtaattcacgagtatcatctgcattcatgaacttcgagcctttaacatgtactatccacccgccagtattcccggggttagtcacctttaagtcgccagtaacacttctagcttcataggttttactgtcattagtgattttttcggtcccaaagctaacaccgggtgcttgatccaaggtaatatctttattagtgtcatcctggattaattcaacttcagctttggtcgatgtctccgtatctgcagcttgaccaacaagtggtaatcctgccattagtgtcatgcctgcaacgagagttccgagatattttttcattttggttgctcctttattgtttgacggttgcgccaccagattagaattaataatattaacaaactaagtccacatacgccgataccgaacagaatccattgctgggtcccattcatttgcggtaatacaccttgtaacggacccgcaattttatcagccgctccattgtcacctgaattagcagtgaccgttacgtggtaagtgcctgattgcgtatcagccactagtggtaacttgattagctgactgataccgaagtcttgaaagctactcatccaattaatacgatcacatcctttccagatatcgacttgaatttatcatcattattaatgcttgttactaatagtgaatcgttgtgagtaaccctatcagcaacgaaaatatatcatggttttggaatcgctgtcaattgatgacgccccttaactattgaataaaattccctttttaacggacttctgtgccatttttaatattatggtgattacaaatattttaatataaactactgaaatcagtttaatcgcaagctttcccgctgctttcatttgttgaatcagagacaactagttggtaccctcaactaaacaagtcgtcaacattatattatcgttagagtttaatgaggctgctcataagttaaaaattttgataattataaatattaaattcctatatatatttagaatatcgttgtaacaacgggctattacataaataatcttcaatttataaaattatgtaatcgatttaatgtggaaatcttttatcagttttaaagtgatacagaatcaactaattaaaatcggctttaaaaacagtaaaaggcccctaatcaaacaattttcaacgttaatatgtattaaccaaacaatgaagtgcgctgtggtatacttaaaacacttatttttaaccagaaaggcggttcgaatcatgcccgctaaaaagacattccaagacgaccaagttatcgaaaaaatcatgcacttattttggcaacaaggctattatcatacttctatggacgaaatcgtaacaactagcggcgtcaagaagcaaagcttatataacgctatcggggacaagcacaccctttacctgcgtgcactccagcgctatcaccaacaaactttaatgcgctgtacccaagcaatgcagcgcttagagcaggatggcgccgcccccttagctatcctgagtatgctctttagccacgatttaacgacatccgaacaaccagccggtgacctaatggctaacgccgtcgctgaatttggtactactgatactgatgttcagcaagccgtcagttggttttacgacgactacctgaccctcatggctgcggtcatcctcaaaggccaagctaacgagcaaattatcaataatcagtccagtatgacactagctcaggcactgctagaagcccgtattggccttcaaacgcgactccgtcaaggcagtcagccagatattcaagcgcagcaacaagcctggatggcttttctagcacgtcgttgaacctaaagcagttaatcagcgcataaaataagcaagcttctcccgaacacttcgggaaaagcttgctttattttttcatctatataagtcacagtcatacttttgggtcataactagcgattgacttataaatatttttgcactaaccagtgctgtgctgaactcgtcaattgactaccataatgttgtcgcaaccgttgtacacccgcgtaatggtcaaattcaaattgacttgtcagcgtctcactagctagcaacgccttagcaaactgtaaatcgtcaatcgcaatctgttgtcggtaagccaagtcttcatcagccatgattcgttgccattgatccgttaagatggcactggcccgctgataacgccggtcatgggtcaacaacgattgcatatcatctggattaagtggtgtgcccatactattcatcctccaagttcaagttaaccacgtgaccgattgctggttcaatcgacaaccggtcttcagcccgcgctaacaaccagatcacattcgtaaagcggtgcgattcaacatgccgttcaccccggccgtccgttaaaatcagcgctaaggtcgtcgcattcgtcttgtggtgggccagtaaatcatcaaagatgctttgatatacggtcccaccgccaccacggcgcgtaaagcgaatctgttgtggtaggcttacttgatacgtttgaccaggttgaacgattgcatcaaacgacttaacggtgatcgtcgttgcgagcaaccgggtcaacgcggcgacctgcgccaataatcgttgcaacgtcaggtcactgattgaacccgaattatcgacatacacttgcaagtctaagcgcgtatcaccaatttgaccgggtaattccatccgcgcgggttgccgtcgattaaagcgcgcgtgcgaggctttcttaccactcggaatctgaccaagtccccgaaccaataattggcgccaatcaagctgggctggctgcgtcattacagtgagctgagcgcgcacgttgcccgccactaaccctcggcctgcttcattcgtctgttgccaggcatccttcgccaactgtcgtaaccgggcagttgccagattaggattcgttaactgtccaggagctgaccagccaccgggatcatcgatcaactgttgcgactggtggtcgccagaccctgttgcgcgctggtgctgatccttattctgcgaagtggctgttggcgcgccactgggctgagattgcgaccgtgactgccgctgcaataattttaaataacggccagaatctgctcgttgtggtaactgctcatcgactaatggttggacagtcatcaagctgacggcgtcgttaggcaagccgtcgacgtactgattaacggccaggtcagttgctaacgtcaccagctctggtcgctgcttgacttgctcacgataccgaacgggatgttgccagacgacgtgcaaggccacgtgttttaaacccgcctgtaagtaagaaaactggggaaaagcctgcgcaatcgcggccggcgcgtattgtaagaccagctgattattctgccaagctaaggtaaacggcgtcgttaacgcgggattcagctgtctggggagccgagtcagcaactcgccataaaattgatcagtcgcgagtaactcaatgatagcgcgatcaatcatggttgcgctcgcctggaccgtattgaccgttggcgttactaacatcgcttgttgccagcgcgtgtactcattggcattgttaatcatgatagctcactaccttcttactgatttgaccagctagcgacctgctgcaaatactgatacaaagcggtcacatacggactctgcttggcaacatttactgtatataattgcttcaataagtcgcgttcatggccgatttgttgaaccaatgcaaactgaccatcttgactgagagtttgcaggagttgcatgaaccgaccggcatgctgatcatccatcaaggggtacgtggtggttaaagctaagcagcttgccaaaaccgtccgcttttgaacttcattcatcgccgtaaactgcttaagaatcggtgccggcaccacggcccccaccggttgactgtcataaatcatcgccggtgtcaggtgaatggcttgttgctccaagaattgctcgaagacgagccccaactcagtgccaacgtctccttgaaagatgtccaatgccacggccgtttgttgatccgcaggcagtttttcaatttcatataagttcgctgaaacacgcgcccatgcccgcggagtcgccgttaaatcagcctggacatcagcctgattgagccgcgtgacgtcttcgctaataaactgctggacgagcggatgaatgtttggtcgctgcaggcgctcatccatttggttggcccaagcaagccagtccgctgcgtccgctcgcatcaccaggcgtacggttcgatctttgatagctgcatcgctggcagtaacgccataagtactactttcgaatccagtcatacttgcatctggattttcggcaatgaccaattgcacctgttctggtaatttcaacgtgttgatcgtccgttgtaagactagattcattaattcactttgaacggcctgggtgccccggttgaattcgtctaagaaccatagaatcggttgctgcggatgctgttcagcatactgaataatttcaatcaacgtgtgtgcatagccaaattgtacatcagctaactggccatagcgcttcgtttgtataaatgagtcgctcgttaggggcgggacgggaatcgctaaatcccccttctcggacagactcacaacggtcgtgtacagttgtgcgcccatccgcttagcaacttcggctaccaacgccgactttccaatcccggcttcaccaacaatgttcggcacgttcccggcttttaaaacgaccggaaccgctgttaatagggcttgatatgataacgccattaattaaaccttcctttactgttccacgtgaaacaaaattgagttattttcaaataatatcatcttactcgtcttaaccattataaaacagaagccaccattatcggcaattagcgttcacggcaatgttaggtcactcgccaatcatactgactgccattaataatgaccggttaaaaacaaaacttttatttagcctaattcaaacggctcagaaatgccatcaatcactgttgtaccagccattaaacgatatcatgaccattaacataattataaaaatcttatcagaaataatcactaattgaacaaattccgtcgttttcacgagcaggtattgtaaaataggttaggttagcaattattcaaaaagggagtgtgcaactatgcgcaagtatctcgccgaatttctcggcacatttatgttagttttcttagggactgcaaccgttgtgattgctaaaggtgacgtcctcgctattgggttagccttcgggttagcaatcaccgtttctgcctatgcctttggtggtatttctggtggtcactttaaccccgccgttacgactgcgatgttgatcaaccgtcgaatcgatgccgccgatgcgatcggctacatcatcgcccaaatcattggggccatcgttgcttccgcagccgttaagtcatttgtcagtgcactaggcttatctgcaacgtcacttggtcaaactgattttccaaaaatcggcagtggtatggccttctttgtagaagcactagtcacgttcttattcttaatggttatcctgaacgttactagcaaggaccatggtaacgcagactttgctggcttgaccattggggtgaccttagcgttcttgatcattgtcgccctcaacttaacgggtggttctttgaaccctgcccgttcaatcggccccgcgatctttgccggtggtagtgcgttatcacatctctgggtctacattttagcaccagaagtcggcgccatcttggccgcattctgtgcccgggtcatggggtcagaagactagtccgcaattagtcgttgcgttattaaccccgattaattgataatagaatataattattaaaacagcgatactgtgatgattttatggcttggaatcatcaccgtatcgctgtttttcgtctgcttaaattttaagaaatatcagttgaacagatccacattgcgcaacttttcgtaacacacggtcctgtgcgcagtaattggcgccccaccgtcactttcacttgcgccgccaatgcgtgtaccaggaatgaagcgttccgatcaagaggccaataatgacgacaactgcggacacataaccaaaaataccaatgtttgtgatccagctattatcaggatggctttgaactagtagtgatgatccaacaatcagcgctgccagaataacggacagtacaatcttattgaccatcgaatcaatccgatcaataaacatcttgcggtgtgcaaagaccaagttgacccgcgtctgaccattctcaaacgtatctagagctgataataagcgtgacggaatcttcggggcatcacgcaggctttgaaggctagccaacatgccatcttccagttcattgcgccaattaaaattctcgcggatgtacttgcgcgcaaacggccgcgccacgtccatcattgataaggttgggtcgagcgtctccacaataccttcgatcgttccaaacgccttacctaacatggtaaccgctggattcatttgaatattattactgcgacaaaccttgaccatttcaaacaacaagccttgaaaatcaatgtcgcccagtcccgaattataatactgacttaaaaatggtgctaactcactaaagaacgcttcttcatcaaccacgccagttcggtttgaaatcgctaagattgctttgccgacttgatgggtatcttcggttgtcactgccacgacaacattagcaattcctgccatcaaagctggactgatctcacccatcatgccaaaatccagataaactaaccggtatggtggtaactgccgtttgccgatttttccagcatgcttaggaaccgtatcatgatacccgatatcatccggctgcaattctcgcaacaggatattcccgggatggggatcggcgtgaaagaaaccgtcctcaaagacttgcttcaagaagttttggaccaagacgtgagctaaataacggcgctcgtcatcatactggtgatttccatcttcatcggccgcaagcatttgcgccataaaatgctgaatcgtcgttcccggcatgtattgattaaccagtaccttttgcgtactgtactttgcataaacccggggcacccgaatgatatcgtccgtattattcaatcggtaaaaccgcgacccgtttttcacctcaatactggtatccaattcgttgaatagtgaccgtttgatttcgccgatcatttcgcgcaaatcaacgactgaggactctggaatataccgcaacagcggtaacgcccgctcaaataacgagatatctagggcgacttccgcgtcaatacccggatgttgtaccttcacgacgaccttctgcccgttgagtagcgtcgcatggtgcgtctgacccatcgatgctgacgcaaacggctgctcatcaaactgggcgaacatctcgtcgattggtttgcccgtctgctgttcgatcgtctgcttgaccacgctaaagtcatcagcccggacgttgttctgcaactttttaaactcgttcgcaaattccggcttaacgatatccgttcgtgaagaaagaatctgaccgattttaataaacgttggcccgagttcttcaaacgccgcgcgcacctggtcgggatttttctgccgggcaaggttactcaaaacgttatagcgccgcaagacactgacaatcgtccgaaaacgggtatggcgattttgattgacttgccattggggcttttcctcattgctgttggtcatcagcggttcctcctcacaaatttccttgttacagctattatccatctttatttacgaatccgcactagctaactaactttttttgaaaaaagattgacaaatgttgatggcggttgtaaattagaaccacattagaaatcgattaacaaacacgccgatgaacaaagtaaaccttctgtgaatgcctagagagtgtcagtttggtgcaatgacatcatgaccagatcgttgaaaatcagttctgagtggcagtgacgagcttaaggttagttgctgttggttgctcccattattgagccgaagtatcgcaggtggccggccacttgccgtactttttgaggtgactcgtcgtaaggcggtcacaaagctaaggtggtaacacgtgttcaagcgtcctggtttctgagtctaactcagatatcaggacgttttttagttaatcgcaactttgacatgcccgatgatctacgcttcatcggcttgattaaataaaggagtgctgattctatgctaaatcgagttcaaaagagaaatttgaccaaacgtgattacgtcaccttaagttccatgattttcgccttattctttggggccggcaaccttatcttcccacttcacttgggtcaactagcgggcggtcactggggcactgccgcggtcggctttctcgtcacggccgtcctattacccttactatccgtcttagccgtctgcgtcacgaagtccaagggggtctatgacattggtaaaccactaggcgcaacctttgccgtggtcttcatggttctcatccactttacgattggccccttctttggaacaccacggacggccaccgtatcgttcaccgttggtctggcaccgtttttcccagcaaagtatcaatcactcgcattactgctcttttccgccgcattcttcggactcgcctactacctgtccgttgagcagagcaaaatcatggctcgggtcggcaaattattaaatccattatttttgctattattagtcgccatctttgccgtcgctttcagcagtccgctagctcatgccggtagcaccagtgcaactgctgcctatcggaccgcgggttttaccaatggtttcttgcaaggctacaacacgatggacgccttagctgggttggcgttaggcgtcaccatcgtcactgccgttaacttcatgggccaaaccgacccgaacaaagccgcgtgggtgaccgcccgagctggcttcttctcaatggcctttgaaggcttgatctacgtactcttaatcttgttaggcgcgcaatcgttaggtcaattcaaattatccgataacggcggggtcgcctttgaccaaatcgttaaccactacatgggtagtgtcggacaagccattttagccgtgttgatcattaccacttgtttgaccactgctatcgggctcgttgccgccttcgctcaggactttcataagcacttcggtttcttgagttacaaagcctggttgagaatcacgtgtctcgcctcatttttaactgctaatgtgggcttaaaccagatcattgcctggtccacccccgttctgatgttcctttacccgttagccatggcactgatcttcttatcgatcctttcgccactcttccacaagtcaagtgtcgtctacgtttgggtcgtcgtcttcaccgtcgtccccgccgtctttgacatggtcgccgctttccccgccgtcgttagccaaagtgctttcggtcaagcaatggcgcatgtccaaagcttcttaccacttgccagcagcgggatggattggttagtccctgcactggttggtgccgtctttggcgcggcccactacttgctattacagcgggcaaaagccagcgctggcatggaagtaccgatgaaacgctaaccggtaccgtactttttgaacagtttaatgaatgctaaataagcactgcccactattatgtgagcagtgcttatttgatacctcaagtctaacacgaacgattatcgcaatgagtcagtgttgtcatgaccgacaacgacaagttatttgaatgtgactttcattgctgattgaccatgctgtacttctgttgaccaagcttcagtgtgtgctgtaacgcgaccgggttgtgtaaagaaagtcacaaccacatcgtcataaccactctgtttgatcagatcacgatcaaaggtcatcagtaaatcaccagcgtgtacgacttgcccatcttgataataagtcgtaaagccagcaccacggaggttaaccgtcccgattcccacgtgaataattgtttcaagaccgtcagctgacacgattcctaatgtatgtttagttgagaacgtaaaccgaatcgtcccatcgaatggcgcgtagaggcgaccatcacttggccgaatggcgaaaccaactcctggtaagccttgtggttgtgcggcacttttgacatccgctaatgcgagcggttgaccgcttactggtgctaagatttcagtggtcagcgtgtcagatgcaggcgttaccgcaacatccgctgcttccccggttgctaatttggcctgtaactcttcaacaatttcggcatgtttcttttcggtaatggttactttaaatgtaaagactaacaatgacaagatcgcacatgctaacggcaagtaaaacgctaagagttcaaacgtatgaatattacttgcagtcatatcggcggccgttgcactaccagtcataccagcaaccaaagcaatggcaccgacgataccgttagaaaaggcacccgtaattttgtcgagcatcggccgaacggcaagcaccaccgcttcattacgattgccattcttcaattgaccgtattcaatagcatcggtcatcgataggaccgtgactaattgggcaaagttaatattgaaaagcactaatccgataatcaataagatcaaattcgtctgcgcaacaataaagataatataggctaaaatcattgagcattggccgagtgcaaagagcactttccgtggaataaaccggttcaagattggatatagtggtgacgtcacaaaaccaatcacagttgcgaccgccccagcaatccaaaattcaccaggtttaccaatcacgaatttaaaaagatagaataggaccccgttggttgtcacgtatgctaatgaatagaataagtaacccagactgacccacataatttggtcattcttgataatgcccataaagacacctttgatcgtcgtcttttgtttggctgcttcccgaatcacattgtgcttctcactggttccaaaggcgacaaatagtgcggaaatgactgccacaataccgacaataacggcaaacgctagccagccttgtggaccttgggtatgcttaccagttgcgataaaggtaaagtacgtggtaatcggtacaacgaccatcgtcaggccgttccaaccgatcgtcccagtaaaactgccaagcgccgtgaaaatcccccgggcatgactatcttcactaatcgctggaaccatgccccaatacgagacatctgttaacgaatagaagacatccaggataataaataaaatcacaaaaacaattgcaaataaaatccagtttacccttgctaatccaaagattcctgagaaaataacgactaataagaccgaactgataatactcccaatgacttgccaaggcttaaacttaccccaacgtgtttccgtattatcaacaatattacctaagattggatcgacaacgacttccgctaagcgaatcaccaccaccagtcctgtgattaaaccaatcaaccgattggcgatagccggtgcaacgccactaaacatcccgctagtgacaaagacgataaaataagtactcaacgcaccatagaatgccgagtgtcctaagttacctaatccaaaggcaacgccttcattaatttgatgccatgataactttttcttggttactggctgttgttcaacattttgtgccattaatttcaccccacttaattatttcttcatcatataaacttgaacaccatagctggccagatcttgcttaccactgaccacttgattctcaaagacctgctgtaatggcacttcaagcgtcaccgtcgttggtcgatgactaaaattgatcacgaagtaataacgcgtcgtcgcattctctctaacttgaatacttaccttggcattcgctttgatcactggcaaggccggtttaagttccaagcttgtggcaagccgttcatagaaagcatccaagaagtcagtatcggtccgcgcagccaaataatacgccgctccctggcccaattgattgaccgttacggccggcgttccagcataaaagtctttttgatacgtgccgaggacttgtgccgttgtcgtctcaactacatcacaataatcattcacttgatacgcttggtgataagcagtcaacgcattatgttgttgcggatataatgtgtcagtttcctgaactttaatcccgtaagttgcttctaagtcagccaaaccatcaccttgataggctaagaaattacgatcgacaacacccgtaatataggtgccaatcagatgcccgccctgttgcacatatgctttaagcttagttgcaaactgggcgctcatcatgaagtgcatcggatcaatcaccaaatcataggccgtcaaatcatcagtagtcgcaataatttcaactggaatatcatgtttccaaaaatactggtaatgttcttgaatcgtgcgccaatactttttagtttcgttagcgtagttgcgggcatcatctaacccccacatgttgtcataatcaaaaacaatagcgactttagctgcagttctggttgttccatgcgcggcttgtaagctttgtaagtcctgaccaactttttgaacgtccttaaatgcccgcgtatttgagccacgatggttggcaatgacggcgccatgaaacatttcagaagctcctaatgattgatgtagttggaaatacaaaactgagtcggcgccatgggcaacctgttgcaagctccccatttcgtgcatacctggtcgtttggcacgattatatgggtgccaattaacctgtgacggtgtgctttccataatcaagtagttatcatgcttgaggctccgcatcacgtcattcatcaaagctgttttcatggccaagtgggccgtactttcgtaaccattactccaattaggatatgaatcccaactcacaatatcgacatgcttcgcaaacttctgataatccaaatcataaaagacgtgtgattctgatgggttgccacccataaaattagctgtcacagggatattaggtgtcagcgctcgtaacggtttgatctcattgtcaaaaaagtcgatcgtccggtctgttacaaaacgatgccaatccaggttaagtcccattacattcgtatcacccagcggcgacggtgcctgaacctgatcccaacttgtataatcgtgactccaaaaagcaccacagtaagcatggttcaaattggctaacgtttgatacttcttttgaacccactgacgaaaggcctgctggcacaagtcacagtaacaagcaccgccatattcattagagatatgccatagcagcaagcttgggcgttgaccgtaacgttccgccaacttctgattaatcatttgaaccttttctcggtaaactggcgatgtgtaacagtgattatggcgctcgccaaattgatttcgctgtccgtgttcattgacacgtaatacttctggatatttctcagctaaccaccgtggccgagccccgcttggcgtcgacaaaatgatcttagtcccttgagcctcggcacgatcgaaaatttgatctaaccagctaaaatcatactgcccctcagcaggctccaacttgtcccaggcaaagattcccaacgttaccgtatttaacttagcggtcttaaacgctttaaaatcctgcttaatcacgtcgggttgatcgagccactggtccggattataatcaccaccgtgcaaaaattctgttgtctttaatggattggacattcaaacgcaccctcacttctatcaacttaattacgctttaacagctcttatgataagcgctttcatttacaaatgtaacccgttttactaaaataattactaaatatcggtaaacactatttacgttttgtttatattcattactgcttttattagcgataatgaaagcgtattattataagtgaagctttttaactctgataatcatctgtttagtaacttatttgtcgaaaggagtcttccactgtgccgactattcgtgaaattgccgctaaagcgggctattcaccggcaaccgtctcacggctgttgaataatgatccgtcattttcaatctcggatcacgctcgcaaaaaaatactacaaactgctcaaaacttgaattacgaacaaccaaacaccactcacggccttgcctatcaggtagctacaatcttcgctgtccaaccaaaacaagaacttgaagatatttatttcagtaatttgcgtcagagtctcgttgaacacggaaaacaggctaatttaaagctcaccttttatccggatatcgaccacattccccacgacatcgacggtgtgatggcagttggcgaattcgattctgatgcgctccataaattgcgccagctaacaccccaccgaatcttcgttgattccaatccagacccgcatcacttcaattcggtacagcctaacctccaagcaattaccgaacaagccatcgatcaattgatagccgcaggtgacacgcccattggtctcattaacggcggctactggaataaagatcaacaagtcacccatcaacaagatccgcgccaaaaatactttgaaagtcggctacgcgagctacagctacttgattcgcggttcctattcatcggtggcgagttctccgttgcaagtggctatcgcttgggacaacaagtcgtgcaatcgttaagtaaacaagcattgcccaaagggttcttagtcggttcagatccgttggccgtgggtgtcttacaggctttcaatgaaaacaaaatcacagtccccactgataccgcaattattagtattaacgatatcgacattgcgcgctacgtttcaccaccattgacgactttccacattgacacagacgacttagccgcacaggctatcacaaccttgaaagatacgattatttttgaccgtccacagaagcgcatggtattagttgatgctaaattaatttatcggaaaagttttgtgaaaccgacgaataaatcatagtttgacacaaatcaaagacacttttggtatgcacttgcttcaacaagcgcataccaaaagtgtcttctaaattaacccattaaaataatgacggctacactgggaccaccgcagttctattaggttccaaagattgtctttgcccatccacaatcaatgtcccaccagctcggctagcagtgactgatagttggtgttgatcttttacgacagtcacggtaccgcctttaatgggtaacacggtgtgtaaatgatgaaattctgataactcaggcttgatctcaaaagtctggtatcctggagccgtgggccgtaatcctacaaaatgacgacctaataaatatatcggactggctccccaggcatggcacaggctcttaccatagggatcaccatacatggcatacatatccttgccatgctgcgacggatcgaattcttcccagaaggtcacggccccgcgatctaacatgccgccccaatagtctaataaaacttggtaaacacggtgttgttcccccagcttacataaagcatcttgttcaaaaaacttaaaatacggcgtggtaatttgagtaatcgcattattcaacaaaacattctttaaaattaattgttgtttgttctcatcaacaacgtcaaacaaaatggcaaaaatattagcatgacgagtaacgtgccgcttacccgattcataactatcaataaatgctccttgttcatcatcccaaaagtatttcattaagttcttaaacaactggtcatacttcgcttggtagctcgccacatctttgcctaagacctcaccacaagtcataattgtcttgtaatcttcaagcaataagatttgttcagccgccacggtaccctgtttatccatttctgaccaatcgacaaagatccaatcatttttccgaccataaataaaaccatgctcattcgtctgttgaataaagtattgcaccatactttctaacttaggataaataattttgagaaattcacggtcacccgtcatttggtaatgattgagaacaccaatcacccacaacatggaatagtcgacaattgtattcatatgttgcttaatatcatcttgcccacgcaacgctaataacgtccgtttatcaatatcttcgttgaagaaagaatattgattgataaaattagcttggtacgcgtcaccagcccaaatccaccgatcacgtttgatcccatcgataaagaacaagtcactgcaaaggtttaacgtttccgtcgctacattccaaatttgattgatcaacttattatcagaggtaaaactggagggattatttttaggaatatattcgtgcatagcagttaattcaatgtcacctaactgacaatgaggcacaaagacatatcgaaacgcacgtttacgaacctttgttgtagctgtaacgtccgactgcttgtaataacacatctcaacatcccgtgcttcagtttcggactccccgtaacatagcgtaactggcccattcgttttgactgtgacagttccattcacagcgcgaccaaaatcatataaaacgccaccatcaactgcttgttgtgctttggccactactttttctgtccgatattcaatcacattaggatcttggttacggtcagtgtagagaatatcgtggccagcgggtaatgtggtgacaaaattgctagctagccaaccactatcagatttgataatctcaccaacaatataaatcgtcggcaatccctgaacgttaccaacaaacacttgaatatcagtcgcacccgcatcacaattaatcgcatgatttaagcgatacttagtgccattaacatcaacatagcccgttcctttggcgagtactgtaaattgtgtggattcttttaaatcatagtgccgtttaaaattaacattacggttgcaatcatcaatataccaataggcaggccaacccatcccacgttcttcacgtttaaaattttgtaacattccttggtggatttcaaaatcaccaggataccataaccaaacagcctcttttgacatgagcattatcctccttgattttaaataaataagcccggcaatgcccggcttacatttttaattcttagtaatattaatcagtttattcagaaaccgctttcatcgttgggtcttttaaaccggtcttcttaataatagcgacaatgatcactgcacaggcaccgaatagcaccgtacatccaaccataatccataataagagttgcggcgaatatcccattaatgttggcgttactagtgagaaagcagcggtcagcacccgaactaagccataagaaaagcccgtcatcgttgcccgtgcatccactggatagaaagtctgactccaaattttataaagggcctcaccacataatactgtgctaccagagtagaaaatataaacaacggtgaaaatctgccagtcatcactaaagatccctgcagtcacaaaggaaagcaatgctacggcaatacctaaatacatcactcggtagcgatacctagtgtctgaaacctttaaatagatcaggttaactaacaggcacacgatattggcaattaatgccacgattgtcgaataggcttgcgtacggccatcaacagtcactaagaaatagttaacaaatgacccccacgtattggccggcaaattccaaaatagataaaaaacagttagtagaatcattggtactaacaaaccacctgttcgcaatagctgacctaatcgatacttcttaaccgattgaccgttagatgcacagtccacatgttcatggtcaactaagtctgtttcaatctgtttaaaacgctttgaaaagacccgcacgcaccaattaataattgccactaatccaatccaaccaaataaggctgccgggcttcccataccactgttagcagttataaaaccaataaactgtgacaacaaaatgcccatcgtccaaaaaatctgagttgaagaaattgcccgaccataaactttactagacatccgttccgaaataaccgccaatgacgttggtaaatcagcaccagaggccaaaccagcaatcacaacaccaataatcaatatcgtcgtattttgtgcaatcgcaataacaaacgaaccaatcgcgacaaaaaagatatcagcattaaacaccgcgacccggccaaatttatccgacagccagccgcccacaaatgaaccaatcgcaaccgcgaccgtcagcatagtacttagtagtccgaccatccagctattcagtgctaaatattttgtccagataggtagcgctactcccagactaacgagcaacgctgcatccatataggaagctagaccagcaacaattattaagagtacgtttgctttactcagctttactttttcgtcaaccatcgcagacactcctcctaaacgaggtacttattaatcaagtacaccggtgtacagctccaagcatgacaataactatttaaaatgggactcccatacggcgaataatcaggttgattaggatcaaatgcttcccaataagtatccgcacctagcgtaatcattttgccccagtaatctttcattaattggacggcctcttgctttaagcctgcttcaaataatgcttccgtaatatggtgatacatatacggcgttgcaataccagtaattggaaacagtttcgtgacggtcgtttgcataagcgccgtggtttgctcaggatccaaaacatgtgctagtgtcatccacacttggcttgccacattaacttcacgctgatcccctgagacaaataaccccgattgcgaatcaaacaattgagttttagcgtactggtttaatttacgcagtatcgctgtataggtctctaagcttgtatcattaaccagttccgcaagcgtaataaattgttttagcgtataaataataatggcctgcccagccgtttctttgtcaaaatcatttgaccagtcgatgaaaaccggattttcttcagtcaatttcaatttaccttcagaagtaacttgtgccaacgccaaatccatttgctttttagcaacacgatataaatcattcaaaactgttttatcagaactaaacgcctcataatcagccaaaattgaaataaagaatagactgtaatcaaacaagaaggtgtcatctggaactgccgttggtttagtaaaaacattggcaggaatccggccagccgttgtaggcatcgcaccgaacaaatacagacaccgcttgaccagatctgtatctttgaacgttgcataattggccaatgcttgtagccgaagatcaccaatccataatcgccgatcgcgctttggtccatcttcaaagacatcctgcatacaatcagctaatgttttcaagccaacctcataaatccgttgtaattgtgcatcggctaatttcggttgatgcactgtcgcagtgtctaccgcacttgtcgccgtgaccactggattgctaaaaacagctcgccattttggtgacgtatcaacaactgtgatctcagcataacgaaaactatagcgtcgtggtaacgtcagcgtggttggcagcacatctaagtgaacagtttcttcttgaatccaagatttgctcaaccaaccgtcgtaatcttcactcttgcgtgctaattctacaggcatttcagcaaacttaatcttaaaacatagtggtgcatccattggtgaaccaacagcgttaatattaatactaaattgaccaacctgatgatcgccaaaatctatgataatttggtcgtcacgtttcaactcataacttgataatcgttcaataggtgcaatttgtttaacaccccatccttcaaggtattgcgtatcacgctcgagcgccacaatcgatgccgccttaacttgggtttctttcagtattggccgatagcttgccgacttgtctaataatgcttgattatgccgaaattgaacatcattattgatttgaaaagtaaacgccatctcttccactcgctttctaaatactttgtttaaaagttattaataccatgtttcttttccaatcgcatcattgtcagccctgctacaaagctaataaagacaatggcagcgaacccaaacatcgtgttacgaattgctgatggcacaactaacgcaggtgtaattaaggcaaataggccacaacatacccgtgaaaagccattaataaatccttgaactgatgcccgaacttcaactggaaatgcttcctgtgtccaaactttatacatcgcttcaccagcaatattattcccaatgttgtaacagccaatcgtgatgacaattggccataacgaatgactactcattgctagtccgagcattgccaaaaattgaacggtaatcccaactaagaagaacttattacgatacttacccccagcgactgatgcaaaagccatggttgccaacaacgagataaagtttaggactatcccagcaccagttgcgaaactttgactcgcatgtgcttgaaccagcgtaaacgtttgaaactgtccgaacgtattggccagtagattccagcaaacatagaagattaaaatactgaagaagaatgccataaagcgtcccttgttggcaccagcaaagaccgtcttaatcgagaccttctctgttgtctgtgaagctgcttcgcgatcaatacgccgttgttcaccttcttcatgaaatgctcggaacttagttgaaaaagtccgccatgcccaagtaatcaaggcaaaaattgctaaaatcgaaaaaacaatccgagcaccggaagcaccggccattttagaaacaataaaggcacaaacataagacatgaaaaccccaatttgccagaagatttgcgtcgacgatactaaactagccgaggtcttatcatccggtgcatcatgcgaaactacggttaaactaattggtaaatcagcccccgaagctagcccggtaatgatgacgccaatcaaaagcatgatataattattcgagaaaacacagatcaaggcgccaatcgcataaatcaggtttaaccaattaaacgatttaactagaccaaaagattttgttatctgtcctgctaataaggatccaattgcaattgcaaaagttagtgcacctgaaataataccaacttgactgttagtaagacctagtccgttctgccacactgtaatagtcgcggataagccaacgataattcctgatcctagaatggaaccaattcctgcagctactgctaatggccgatattttttcaccattgaagttgacgtctcgccgttattcatatgaagaacctccctttatttatacgaatattgtaagcgattactgtaaggggtaccatatctcaactacatgaatgatcgtgcaaaatcacaggttgtactaaacgataaatattaaagaaggttagtattaatgactagtaaatttctcaattacgaattatttgccctgacaccggttgagctaaagcaacgccaatcacatggtaacgttaactacatggacttagactatgtgaataatccgattccccagatgccccgctcagatttttttaagcacggtgatattgctgttaccaaaaataatcgcttttcctatgttccagctcacacgcatagctttattgagcttaattatatgtatgctggcacttgtactcagtatattaatggcgaaaaagtgaccctccatcagcacaacctaattttgatggataaagacattgttcagcaaattgaatcaacgggcagtaatgatattttgattaatatcttgctcaagaatgactcaacgatgaaccaacttttcgactatattgccgtttcaaccaatgaaatcactcaatttttatataatgcatcccacatcaatacgttgcacaacaactttattctgtttgacttaacacaccaagaagttgccatcaatctagttgaaagtttaattatcaagggccttacaaagagccgccaacgtaataaatcaatgggcctgctgctatctacattaattcttgaattatcgcaatcgattgagcaagaatacattaacttttctgacaatacggacgacaatcttttgccaatcattcagtacatcaatcagaatttcgccagcgtgacattacgtgatgtcagcaccaagttctcttataatacgaattatctgggtaacaaattaaaagaagcgacgggcaagacctttaaagaacttgttgaccgccgccgaatttctgctgcccaaaatctgatgatcaagactaactgtacactcgctgacatttgcgacatcatcggatatcaaaacacctcatcactctttcgtctgtttaaaaaatacctaaagaccaccccatccgaatataaacgaaaagttagtggcccactcaagcagtaaaattgaccgctgcgacaaacgtcatatatctcactaaactaaaacaacaagtgcactcagattagaaatttccgagtgcacttgttgttttactttaagaccattcttagtatcacgactaacaataattgatctatttggttagtacttccaggaacacctgtgccatcatctcagcatcatcttgaattgacgcttgcatgtaagcatcctgctgtgcctgggtatagttgatgtcaaaaccatgctgccaagccaaaacctcagtaaacagccgcgtcgtgcggccattgccttcccgaaacggatgaaacatgttgatttcggtgacaacttgtcccaacgcctgtgcaagctgttcccgatcattcggtaacatcgcaaaagtatcgagttggcgttgaatatctatctcagcattaccaaataaagacaccgggtgaaaaaacgtcaccacgccattcgcggtcttgttgaaatcaacttcgcgatagtggacccgcccagtcgtaaacttcgccgagcaaaaatgcattaatcagtttcaattctccaatttgacgtcccgtcaattgatgagagtctggcagaagatagtgattgcgggataattgctgttgccgttgcgtactcactttgtactcgattttctgcaaagtagtcgcttcagtaatgcccaagcgatttttcaaagttccatttggttgtaggtaatccgcccatacttttttcattcagctttcctattggtcgaagtacgtatctttgctagcatctcttgtgcgctaatcgggccttcgtcatagaaacgacgagcgtcttgaacatcttccttagtcggctcaaaaccctcatacatattgctgataattgcattcatggtcgcccggtattcctcttgattccgaaactgcacacccatgatggtgaacttctgatcatcgtgttctaaatacataatcgtattctcctcctcgaggtttgtcagtgcggtatacaccgcatcgtccgtagccaaaatctgaatcaaacgtaccgcggtgccacttggttggtagtccgcttgttcccagtgctgtaccgttctaaccgaggtgttgagtaactttgccagttttgcctgactaatttggtaatgttgccgaatctccttaaggattgtggcagttgttttcatcttcatcacctcactcataattatacccttgaagggtacaattgtcgttattatggcctcacaccttagcaaaacagatcaactaatcagaaagcagtggcatgaccgatcaatcccaactagtgccccatcaaagttatgccccgcttgttaacaatcgggtggcacattaattaattacaatatttctgccaaatttcacgaacactcgctgaattcatttagtgctttcacgttctaccaacgtcgtccccagttcaatgcgctgggctgcttgacgatcatcttggaatcggctcaccaacaaatcgatggccgtctttcccatcagttcagtctcaacattgaccgaactaatctctggatacacatattcggccagcgtcgtgttattgaagctaaacaacttgacccgctgtggcacagcaatatcagcttgttgtaacgctttgagcgcaccggctgccatcggatcattagcgataaagaaggcgtgtggtaagcggtcacctaacatttcaatggcccgtttcatcatcagataaccagattgactagtgtaatcaccagctaatacatactcagcatgataggcatgatgccgctgcaacgcctgttcaaagctttgctgacgttgattgggaatctccacctgctgatcagtggaccactctttgccataaatcatgccgatatcttggataccacgccgccaaaaataatcaacgacgcggttagtagcaaacgtaaaatcagtcaccacactgctgaatccctgagcaaagtgatcgtcatcaacaaaaacaagctggtttgacaaacgactcaactgttgtacttggacagggctaaatttccccaccgccacgattgcgtcaatatcatcgccaacctgatctaaattattctggaagatactagtcgtcgtaaaaccacacacttgagcttgatgctcaattcctttacgaatcgctaaataatataagtcatcatgttcttgaatcttagagcaccactgaatcacagcgatatttttccgcattagcgcctttatatgctgacgtttacgcttactgtaccgcagctcgccagcaatcgtaaacacgcgcttgcgtgtctgctcgctcactgatagtgtcttgtcataatttaagacccgcgataccgtcgccaatgagacatctgctcgttgcgcaatatcttttaacgttacggccatcgtcattcctcttttctcttaattagcactgaataacaaacgtggggcaactgggcgtgacactattcaccaatcatgactcgtcggtaaatcgcgtctgcaacaccccgttgccccacgtctttatttgattaacaacttaatcgtgcattgctgcgacaaaacgatcaaaggctgtctcaccagcgtcatcccacttaaagaccccagcgtcagccagaacccgggcaaagacgttgccgaccgccgtatcaataacagtcgtcacgttgtcagcggtgatggtattagtggccttcaattgatcagcccatgcttgatgcatcgcgaccatttgattaggctgatccaacaagtatttgccgacttcagctaattcagtcttcaaccgggctggtaaaatggcccgtcccatcacttcaatcaagccaatattttctttcttgatatgttgaacatcctgatgtggatggaagatgccatctggaaattcagcagacgtctgattatcacgcaaaacgatatctaatacgtagtcatcgccaactttgcgtgcaatcggtgtcgttgtgtgatgacgtgtgccatccgtataagcccgaacatccacactctcgtccgaataattcttccacgtctcatgaatcttcacagcggcatccgttaatgcaaccaagtcctgactcgtcagccgaatcgtcgacattggccatttaacaatcccagccttaacacccgcgatacctaagtcaatcgtgcgtgcaattggcgctttcatcattggaaattcgtgccgaccaccttggtaatgctcgtgtgacagcattgaaccaccaacaattggcaagtccgcattactgcccacaaagtaatgtggaaattgctgaacaatttcaagtaagttggtaaaagtttgccggttaatgaccattggccggtgctcttgatccaagaaaatcgagtgttcattaaagtaagcatatggagaatattggaaaccccaagtattgccaccaagtgttaaccgaataattcggtgattgctccgtgctgggtaaccgagtcggcctagatagccttcattttgcatacatagttggcaaagtggataaccatcttgcggttggttacgcgctgccgcaatcgctttaggatccttttcaggctttgataagttgatggtgatctctaagtcaccaaacggcgtttttgctggaaagaccacgtttttcgcaatggcccgcgtcttgatataatcattagctttgcttaagttaaagaaatagtcggttgccgtttgcggactaacctgatacttatcccaaaaacgttggtttaatacggatggtaacggggtcacaagatccatcaattgatccgctaagatatcttcatccgattgggtcgcttcgatcttgccattttgaatcgccgttttaaccaaggcatcggttaaacttgttaattggtcatcactcgccgcaatcggatcaccctcgccgaccaaaccaagaacccggttatgcacatagattcggtctaattcagtatattgcgaaggcgacgcaatcaccgccgtgacaaattgatctaaactcgtcattatgcttggcctccccgatcatcatagccagccggatgactttctttccaagtccaagccgtcttgataatttctttcacatcatcatactgcggcgtccagcctaaaacggtgcgcgccttgtcactagcggcaaccaatgtacttggatcaccagcgcggcgtggtgccatgactgctggaattggcttaccagtgacttcgcgagcagcgtccaacatttgtttgttggagaagcccgttgaagaacccaagttaaatgcatcgctatcgtgcccctgcttcaggtattccaaagctaagatgtgcgcgtcggctaagtcgaccacgtgaacatagtcccgaacattggtcccatccggagttggatagtcgtcaccgaagatctgtaattgatcccgttcaccagcagcgacttgtaaaatgattgggacgagatgtgtttctggtgcgtgatcttcgccgatgctaccatcaggcttagcccccgccacgttgaagtaacgtaaagctacgaacttaattccgtaagccacatctgaccagtgcatgatcttttccatcgctaatttgctttcaccgtatgggttagttggcacttgtggatccgattccttgattggcacctgcttaggttcaccataagttgctgcggtcgatgagaagacgatcttcttcacatcgtgcttagccatcacttcgagtaacttaaccatccctgccgtgttgttatcaaagtacttgagcggatccttcatcgattcaggaacaactgagaaagctgcaaaatgaatgacaccttcaacgttttcttggtcaaacacggtattcatgaacgccgtatcccggacatcaccttcataaaaacgcgcgtgttcattgaccgctgcccggtgccccgtgaccaagttatcaacaaccgccacgtcatacccctttgcaaccaaccgatcaactgcgtgtgaaccgatgtagccggcaccacctaaaactaaaactgccattctaattcctcctcaatatttctcaatgcttactgctaatttgtattttaaatcaattcttttattaaagttccttagggccgtctgcgatttcagcaatgtagaaatcagcgtcgtaaccaatcgtgtcgcgataaactttaccgacgttttccttaaaggcatcaacttggtccttatcaacgatggcaataccacagccaccaaagccagcgccagtcatccgcgcaccaagcacgcctggttgtttccaagctgtttcggctaatgtatccagttctttcccagtcacttcatagtcaaagtgtagtgaaacgtgggaagccgtcactaattcgccaaaggtcgttaaatcatcgtcagccaaggccttagttgcgcgaatggcccgttgattttcgaaaacagcatggcgggcgcgtttgatcaaggtttcatcattgattaagtaggccgcttcgtcaaactggtcgttagttaaatcgccaagtgatttgatgtccaacttagtttgtaaccggcgtaatgcttcttcacattcagagcggcgttcattatattttgaatccgccaattcgcgccgtttgttcgtattcatgataacgattacgttgttgcctaactttacgggtgcataagaatagtccatggtgttggtatcaagtaaaattgcttggtcctttttacccattccaacagcaaattgatccatgatcccggagttaaccccaacatagttgttttcacacttttgaccgatcttaacaagatctaattgactaataccgagattaaagccggtatttaacatgatacccgttaataattcgattgatgcagatgatgataatccagcaccatcaggcatgttgccatggacgtagaaatcaaaaccatgatcgaacttaacgccggtcttcgcgatttcgtccatcattcccttaggataatttgtccaaccagcggctttgtcgtacgacaggtcgttgatgtcaaacgtgacgatcccagcatctggaatgttagctgagtacatccgtaccgtcgtatctgtccggggtgcataaacaccatatgtcccgattgtaatcgcacatgggaaaacatggcccccgttataatcagtatgttcaccaatcaagttgattcgaccaggtgagaaaaagacccgttctggcttggtgtcaaaggcttcggtaaactcctgttttaagtcgctagtattcatgaaaaatccctccgtaaattgttttactaaaattttattaatttgactataatgcttttttgggttgttgtcaacaccctatcaatcctttaatagcaattttggtaacgctttatagagttttgatattttcaactttgctttccagcatagccctttatcctttctgatagccaccgccatttagttaaattttaactaaaacgacatatacaaatttaataatttgttttattatgaatgtaagcgtttttattatgtaactttgaaaggagcttcctcatgcaagctaatcttcaatggttagatgacccagaagtcttccgggtcaaccaattacctgcacatagtgatcaccattattatcacgacacagcagaattcaaaacgggtagtcgcttcatcaagagtctcaatggcgcttggcgttttaacttcgccaagacaccggctgaacgcccagttgatttttatcaacccgatttcgatgcaaccgactttgatacgattcaggttcccggtcatattgaactagccggctatggtcaaattcaatacattaacacgctatacccatgggaaggtaaaatttaccgtcgcccaccgtataccctcaatcaagatcaattaacaccaggcctattcagtgacgctgcggacaacaccgtcggctcgtacctcaaaaccttcgatctcgacgatgcttttaaagggcaacggattatcattcagttccaaggggtagaagaagccctgtacgtctggttaaatggccactttgttggctacgctgaagatagtttcaccccttcagaattcgatttgacaccgtatattcaggaccaaggtaacgttttagcggttcgggtctacaaacgcagtactgctgcctttattgaagaccaagatatgttccgcttctctggtattttccgcgatgtcaatttactggtagaacctgctagtcacattactgatttagacatccgcccagttccgaatgccaatcttaaaagtggcgagctcaacgtcactactaaagtaaccggtgaatcagccactcttgcgctgaccgttaaagaccatgatgggcaagtactgacgagccaaacgcaaaccggtagcggcagcgtaacctttgataccatgttatttgaccaactgcacttgtggtcaccagaaacaccgtatctctatcaattgacaattgaagtttacgatgctgatcatcaactcttggaagtcgtcccgtatcaattcgggttccggacggtcgaattgcgtgatgataaagtcatttacgtcaacaataaacggttggtgatcaacggggttaaccggcacgaatggaacgcccacactggtcgcgttatcagtatggccgatatgcgcgctgatatccaaaccatgttagctaacaatatcaatgccgatcggacctgccattatcctgatcaattaccttggtatcaattatgtgacgaggccggtatctacctaatggccgaaaataacctcgaatcgcatggatcatggcaaaagatgggtgctatcgaaccttcttacaatgttcctggcgataatccacactggttagcagcggtgatcgaccgggcccgttcaaactacgaatggtttaaaaaccacccatcgatcatcttctggtcacttggcaatgaatcgtatgccggcgaagatatcgcggcgatgcagactttctataaagaacacgatgattcacgactcgtccactacgaaggtgttgtccacacaccagaattaaaagatcgcatttctgatgttgaaagtcggatgtacgaaaagccccaaaatattgtagcttacttggaagataacccaaccaaacctttcctagattgtgaatatatgcatgacatggggaattctcttggcggtatgcaatcatataatgatttgatcgacaagtacccgatgtatcaaggtggctttatttgggactttattgatcaagcgctctttgttcatgacccaattacagaccaagacgtgctccggtatggcggtgatttcgacgaacgccactccgattatgaattctccggtgacggcttaatgtttgccgaccggacgccaaaaccagcaatgcaagaggtgaaatattattatggcttacacaaataatcaattacacgttatttacggcgacgggagtttaggactacagggggctaatttccactacctctttagctatgaacgtggcggacttgaatcactcgtcgtcaacgacaaagagtggctctaccgcacgcctacgcccatcttttggcgggcaacaaccgataatgatcacggtagcggcttttcagtcaaatctgcacagtggtacgcggccgataagttctcaacttgtcaagatatcgaattgacggttgacgaccaaccagtcacaccgttaccaattgcaccactcaataacaagtacacggatcacgaagttgccacgaaagtttcactggcttaccacttcgttactacgaccgttcctagtaccatcgtcacagtgacttatacggtgacagcagacggtctgatcaatatcgccacccattatagcggtcagtctgatttgccagagctacccgcatttggtctgcggtttatcatgccaactaccgcgaccggcttcgactataccggtttgtccggtgagacttatcctgaccggctggctggcgcaacacacgggcaattccacgttgacagtctgccagtcacaccatacttggtcccacaagaatgcggcatgcacatgcaaactgaacaagtgacagtaacgcgatcaacaacacaaaataacgctgaccacgacaacacaccattcagtttgacatttagccaagccgatgccccattcgccttcagctgccttccctataccgccgctgaactagaaaacgcaacacacatggaagaattaccattagcacggcgaacggtcttatcaatctacggtgccgttcgtggggtcggtggcattgatagttggggaacggacgtagaagccccatatcatatccccgctgatcaagacattgacttcagctttaacattcatttctaaaaattaatttgatttcaaaagaacgctccggcaagttatatgccagagcgttcttttggattaacgataatcaagttttaatatgcttaacggctgagcttagtccttagccttgaagtaatgtacctgcgccgtaaagtcactagtttgaacgggagtcgtgtagagtcctagttgcatcaattcatcgccaccgtacattttatttgtgtcggtctcaacgtaggtctgctgagggtctaatcccgctaacttcgtaatatgcggttctggttgaactgcacctaaaataacgaaggtgaacagcaaggcttctttctgatccggactaacaaacatccacgcgaccgtattagattcaaacgggctctctaatcgatagaaggtcccgtattgaactaactcacggtgctgcttatagaaggcgacctgcgctttaacggcctgcttgtccgcatcacttagttgggccgcgtccagttcatagcccaaggtaccactcattgccacagcaccacgcatcttcatcgacgtcgaccgtcctaacaattcatccgggctcgtcccaacatgggcggtaattgcagaaattggataaacgagtgaagtcccatattgaattttgagccgttcaatcgggtcattattatctgatggccaactctgtggcatataatacattaaaccagcatcaaagcggccaccaccgccagagcagccttcaaataagatctgtggatagcgttttgttaaacgctccatcaagtcatatacacctaagataaagcggtggctagtctcaccttcatgagctgaaccgctatgtggcgaatagacttccgttaaattgcggttcatatcccacttgatataatcaatgggcaccttatcaagaactgcggtcatttgttcaaaaatattgtcgacaacatccggttggctgaaatcaagcacgtattcgttccgcgataacgttcgaccacgatccggtacgcctagcacccagtcaggatgggcccgatagagttcggaatcagccgaaatattttctggctcgaaccaaagtccgaaccgcatccctttatcatgggtccgtttgctaatatccgctaagcctcctggtaacttgttccgattaacaaaccagtcacctagcgaactattatcatcatttcgatgaccgaaccaaccgtcatccagcacaaacatttcgatacccagtggtgctgcagcatccaagattgattgaatcttgtccgcatcaaagtcaaagtaagtagcttcccaattgttgatcaagatcggccggagatcgtgcttgtaacgactgcgcgccacgcgatcacgcaataaatcatggtaggtttgcgacataccattaagccccgtcgtcgagtataccattgcaacctcaggcgtttggaaactagcaccggccgccaatcgccagtcgaaattatattcattgattcccatagtcaagcgcgtctgaccaattgggtcccgttctaaactaatctggtggttacctgaataaattagcaatacaccaaggacattgccttgaaattcattagtattcggatcagctagcgccacaaaaggattcatatgatgagaactagcaccccggcgactttcaaactgagttacacctcgatggagccgttcacgactaagctggcgctcacgcgcatagcttccaggtaacgaaatggcatctaatggttgggttggcaggtccatctgcatcgaagccactttttctaagtcgacagcttgctcactgtgattaatcaaccgggcgctacgcgtgataactggccgatcccgataaatcgtgtaggctaattcgagtgtcacgcctaatgtggcatctcgcaacgtcacaatcaaagtttgggcttcatcctcatcttcgacataagtttgtggcaagcccttaagttccggcttaccggcttccatccggcagtcttgataacgaaaatcaactgttcgagcaccattggccgcgcgaataatcgcggcgggttgccgataatcaccggtgttattgccaccgtattcctgtggcaaatcatccttggaatagcttcgatcagtcgtattcggtaaatttcctgagaacccccgatcaatccggggatactgacgctcgccatgataaccccgaacccgtgggccaaagtacaagtgggctagtacgtttcccgtctccacgcctagaatatacgagatttgatcgttatgcaggtgaaagacaagttgttcttcatcaatgtcaattaaagtctgctgcaacgttactgccatagtaaaatcttcccttcgctattagctttttctatttcagttcacaaaaagagctattaatggctcgcgtcattaatagctctcctcgtaaagaaactatgcttgatccggtaagccgacattcgataattgtaagacatcttcatcatcttgtacggtggttcctgaatctttaagatacgtaaattcgggcatatctttatagtttgtaataacgaccataacggtatcatccaagccagccttttcaattgctggttgccagaattcaattaattcttgcccttgtgtgacatggtcgcccttctcaacgtactgaacaaatccagtcccacgcatcttaacggtaccaatcccaatatgaattagcgttaaaataccggtgtcagagcgtaatccaatcgcatggcgagtcgggaaggttgcaacaacttcaccatcaaatggtgcgacaacgcgaccatccgttggtttaatggcgaaacctttacccatactaccgtttgcgaaggattcgtcagcaacatctttcaaactgatcagttccccggcaacaggatcttgataaaccgtcgtcttggcatcggcttctgcttcaacttcagcaggagtttcatcggtttccaagtgagttgaccatgttttttcaagttcatcaacgatttgtgcatgcatcttttcatccaacttaaccttcttgaagaagatgaatgtcccaatcaaaatcatagcagcaggtacaccgaacatcattaacttgaagatggcagcgccatggctagtcacatcaccagcagtggcaccagctgtcatcccagcccaaacagcagttaaaccaacgacaccgttagaaatcgcaccgcctaatttatcaagtaaaggccgaacggataaggttaaagattcgtcacgatgaccaaacttcaactgcccatattcaacagaatcactcaaaaccatcaaaacaactaagaaaattaatggttgtggaatgtagaataatacggccgctgttaagatcattggtaatgactgaccagcaaaggcaaacatgatcagtgaaatcatcataataacaactgctaagaagaacactttacgacgactaaacttctttgctaatggtgggaaggccaatacggcaaaaatcccaataaccgcatttagcgaacctaatagtgtaaacttcgaggcgtcacccaaaatataagtgaagtagtaaagttctagtgagttcgtaatggcaatccctgccgtgtagatcccatacatcaatgataaccacatcaattgatcgttacgggctaacactttgaagacttccttgaaactagtcttttcagtgttcttacgcaattcagaatcattttccttagttccaagtgcaacaactaaggcggagatcaaagcgatggcggcaataatgatcccgaaggccatccaaccacgattatcaccttggccgctgttagacttaacagaaaacattaagacgattggcataacgataaccccaacgatgttggcaccaatgttagagccaacccgggcgtacgtcgccgtcttttcacgttccgctgagtcaaatgagattgctggaatcattgaccaaaaaccaacatctttaaatgaatagaaaatatccattgtaatgtataaaattgcaaaaataattaaatatagaatcgggtttgaggtatttaaaccacctaaactcgtgaataaaagtgctaaaacgacagaaccaataatcccaccgataacaatccatggcttaaagtggccccaccgagaattagtattatcaatggcattcccaatcaaaggatcaattgctagttccacgaaccgcaaacctgcaataatcatggtgatccaggcaatcatttgtgtcccttgagccccactactcttatcgaacaagtgggaggtcacaaacataataaaataagttgataaagtggcatagaaggcatcgtgcccaaacgccccaaacgaataagcaagtcgcgatgttattttacgacccttactctgctttgtctctgcatccataatctcgcctcacatcttccttgaataatttacaagtttaaatgtaatcgttttcagaagtaatgtcaatgttttttagtaaaatttgcttaattgttttagtaatcacctgatagtatcaatttcaatgatcacctgataccaaccaaatcccgtgaaccattggggtttctatcattcgcccaactaaatttaccaaatcggcattaacatctcgctgctagacacgcattacaactttaaacaacgtttactagtagccaaaccggccccgtgcgcgcaaaaaagcgcccccgacgattgagggcgctcgtgatttcacacaaggagttaattctagttcaaacgttcgtattggtaacgaatcgtatgggtcactggttgaccaggacgtaagacgatgtcgccaaaatcaggatgattaatggcatctggcaaggcttgcgcttcagttgctaaagcgttgtattcatgcgcgtcttgcttgtctgggtcgaatgggttagccgtgaaaataatcagactatttcggtcagagtaaagtttcacttggcgtttacccgcagtatcaccgacgattgcaattggttccgtagcacttggcgttacttcataagcatcatcgaattcgatgccaccattttcagtcttcaattgggctaacgccttttcgactggttgaatttggttaaagtcataggccgtacccttaacggccaacttcttgccagttgggaccttttcatcatcgaattcgagatgagcagcactggtaatctgaagttgttgttgtgctaagctcgtccggtcatcggtcgtattccaataaacgtggttcgttgggttgaagagcgttgcggcatcagtatcaccagtaaaggcaatcgagacttggtcttgattatctaaggtaaacttgattttaacgtccatatttcccgggtaattatcgtcagttgacttgatatgcttggacaatgtcacgctgacactatcatcatcctggctaaattcaccgtcgaaattcaaggtattaaagccatgattaccaccatgaagtgaatgagtctgttcattcatatcgacattataatcctgaccgtcgatcttgaacttggcgccaccgatccgaccagcgacccggccgattgattggcaaaggcagaagccgacccgttggtaatcagccatactgtcgaggccccagatcaagggatgttcgacgccatcttcgttaacgacaaattcttgccaagtcccgccataactcaagactgaaatccgcgtctgcttgtcattaactagcgtgtaacgcatgacatcttggccatcgagttgatcaaatactgtttttttagtttccaaaacatgccacctccgtgttatttaaaccgctttcatttagtagtataccaaacttttcatctgatgaataaaagttttacttaaaaagacgtgagccaataattcggctcacgtctcacttctgattatttagtgcttgcacgttcaactagattggtccctaattccacgcgttgcgtcgttgttcgcccagctaaacggctcatcaccaggctcacggcagtcgcccccatgagctcggtatccacgttcaccgcactcaactcaggatagacaaaggtcgctaacgacgtgttattaaaactaaacagtttgacccgttctgggacctgaatcccactggcttgcagggccttcagtgcgccggctgccatcgggtcattagcgacaaagaacgcgcctggcaattggtcgcccagacttcgaatcgccttttgcatcatcttaaaaccagactcactagtgtagtcgcccttaaagacaaacttgggatcaaaggcgtgacggcgctccatcgcggctcgaaagcctaacattcgccggtcgacgacggtctgctgatggtcagtcgtcatttctgaaccgtgaataaagccaatatgatgaaagtttcgttgccagaaataatcaacaactttttccgttgctaaccgaaaatcggttatgacactgtcaaagccggcttcaaactggtcgtcatcaacgaagaccaagttgtcggtcaccgcagcgagatcatcaacctgagtcggactgaattttccgactgcaatcacggcatccacgtccgggcccagttcctgcaagttattttggaaaatccgggtaacttcgaactgattatcctgaccgcgccgttcaattcccatccgcactgacatatagtacaaatcgtcttgttccttagattcggaataccactgaacgatcgcgagtcgcttacgtgcggtcgtaatggtatgccgcttatttttagaatattgtaacgcttctgcggcatcgaggatgcgcttccgcgtggtctcactgactgacagtgattgatccttattcaacacccgcgataccgttgccaacgataccccggctttattcgcaatatcttttagcgttgccgccatggattggcccccttaaatttaaacagatactgacactatctaaagtcgctatcgcatgctttatttcgtaattaattgtcattttaaagtgttttgtcgattttagcacgtatttgagataactatcatgtaaaactttatcattaaatatgaaaattagcgaacttaagcattaatttctttaggagttcattatcatgaaaaaaacattattaggacttttattctcagcagcattgattgcaacatcaggtttgaccgcgagtgcggccgatacgccacaaacgtctaatgggacagttggtttcactgggggcgacatcactattgataatggtgatacggacttagctggtgctagtcttgactttggtaccaaccaaatcaccgcagctaacaaagacgataactatgacaacacgaataagtcagcggcggtatccgttgtggacttacggggaacggctgctggttgggatttacgtgtgaagcaaaatgacgtttttaaaaacgacaaagcggttgctaataaagaattgacgggtgcgattctaacattgaatggtgttttggattcaaatgcatcgacgactggtgcggacgcaacggccaataccggtgttgcgctagatacactcaatagtgacaaggttttgatgaccgccgctgtgggtaaggggaatggtaagaacgtggctgatattgctaagtcacaactaatggttcccaagactacggcacgagctacgggaagttatagtacaacgttaacttggagcttgaatactgcaccagcgaacagctaataagtattgatcggaaaaataatggctagtaggggttaatgtcatttttccgaatcatgattagggggagaaatgatgttaacaaagagatggtggcagttaggaattggtttgctagtcggattagttagtctaagctggggacgaacgggttcggctaacacagtcggttttgaggtcgcaccagtggcttccaaatatcaaatcgataaggctgtttcatactatgatctgaaactaaagcctagccaaacaaccactttggcagtgaaagtgacgaacacaagtacccaggaaatcaccgtgcatacggcaattgtaccggcgacaactaatcccaatggggtggttgagtatcaggcaacggctgatggcaagaacattgatttgccagctgatgctagtcaactgattacgacggcggcggataagattatccttgctaagggaaccagtaagatcgtgacttttaaggtgaaaatgccggctcagaagtatgatggtgttgtcgttggtggactgagtttcttaaaaaaggccgccaaacaacagagtaagagcgcgatggcgattaagaatcaatacgcttactcagtggcggtcgtattgcatggtgatcacgcgctcaccaagaataagttgacattgggtaagattgatgcgacgcaaaataacgggtataaccaaattagtttacccctacaaaatcgaacagccgctttcttgaatcaagtcaaaactgatgtccaagtctatcgtcgtggtagtaacaaagtgcgctacaagcaggtcaatgaacacggtcagatggcgcctaattcagtttatgccttaccgttacgggttggccgggatgcgttgaaacccggccaatataccgctaagttggccgtgacgtccaaaaagcaacattggacgttcaccaaagattttgaaatcacgcgtgatcgtgcgaaccaactcaacaaaaccgccgtgattgaacatcatactaactgggggttgtggatcagcctcggtctgctagtcatcttgttgttactgattgcttggtacattcatcgcaagcagctaaagatcaagcgattagaagaacggcttaaagataaatcataaattcatagccattagtactgttataaacggactcggtcaggttggccgagtcttttttgtgggttcggtggcaatgaatataaatttacctttgctaacttactcattatctttttgcaggcaatgcgcagcggcttgtttctaagtataatgaaagtgtagttaacttaagggatgtgaatgaagatgaagtatgaatggcgtaaacaagaaaaaacaatctatgctactaaaaagcaaccccaactgttgacgattccaacccaaacttttatgagtatccatggaacggggaatcccaatggcccagagtttcagacgcacctgcaaacgttatatccagctgcttatgggctcaagcatgcgtataagcagtatgcgcaaacacaggcgtgtgaatttgatgattacgttgtttttccgcttgaaggggtctggtcattgacgactaagggacagcaacttgaccatcttgacaaagatgagttcagttatgacattatgattcgggtcccagactttgttcccactgaactgattgcaccggctttggcagcggttaaagctaagaaacaactgccaactgaacaaattaacgtgcagcagttcgacgcaatgcaagtggcacagattctacacgtgggtgcttatgacaatgaacccgcgagttttgccaagatagatgaactggtcgccaatcagggtatgcatcgtactagcaagattcatcgagaaatttatttatccgatgcaaggcgggtggcacctgataaactgaaaactattctccggtatcgagtggcatcgaattaatgcgaaaacttttgattggcattgggcgtgaaacacgaatataatttaaatatattttaattcatataaaattataattaaggggtgctgatagtatgacgcaaatagagattagtgatcggctgaaagctttattggttgcgaagggctttgataagaagcaattggttttggtgacggatgatggtggtggcaagtactctttgcacggaggtgcttgcagtattggaactaaatttacgataatcgtacttgaccagccggacccggaatacagcgtaacggtggtgaataatcaaggtctcgcgctttggacctccacatacgatctcattttctttaacgatggtattaagatggattacgatcaggggcggatcgctattaaggacaatgctcatatgctggacaatgccgttcaaatcgctaaaggagcggaagttttagctgcttttgaacagggcgtcccagccgataacctaacttgttaattgcgatatgaagaaggcatgataatgaaggcagttatttttgatgattttggtagtcccaatgtattgcgcgttgctgacgtgcaacggccggtggcgacaactgcgaccgtcttagtgaaggtcatggcggtggccgttaatcatgttgatacgtttgttcggagtggggcgtttaagacggccctggcagcaccacacgtggcgggacgtgatttagtcggcgaggtcgtagccagttcgcaaccggactttcaaattggtgaccaagtctggacgaactcaatgggctatgaaggccgaatgggcgcaacggccgagtatgtggcggtgccaactaatcgtttgtatcacgttcctgatggcgtggcgcccatgccgctcgtcgcggcggtccattcagctgcaacagccgccatcgtacttaacgacgtcatggaaatttgtagcggccagacactcctaattgaaggtgccgcgggcaacgttggccgtaagctgattcaacttgcgcatcaaatgggcgtgacggttgtgacaaccgcatcaccacgagattttgcacggtgtcagcagttaggcagtaccgcctgttatgattatcacgcggggtttgcggaccagttaacgacagatcagtggacttttgaccatgtgatcgatacctcgggacgcgtaccactggcgattaatttagcgttattacgattaggtggtcaggtgacattgattacggcatcgcaggataaccaatttgagttccctgttcgccagttttacatgtctcaacagcgaatcactggttttgtgattagccatgcaacggttgaccagttagcacaagcggccagtcgtttaaaccgagattttagcgctggactgctattggatgatcaggtcagccagcgatattttaaggatgccgctcagtgtcacgctcaattggaagcaggcacggatcatcaccagcgctttgtgttattaccgagttgattcagcataacgattgaaagcctgattaattaatcagtaatactatgtcaacaatagtattgtaattttggtgatttaaagtgattacttggcaggaggactggacagtcggctcccgcgcttctaaagttgcgaccaatattatctgtgaaaggaccggcgtgctaacaatccgaaaggtgatcgatacggcgacctttactaatgttaatggcattcctccgtggtaatacgcagacttgaaaagaatatcgatgacgaaagtccaacacttgtcagcaagggttggactttttgtggtgcagcaccagaagcaatggcagaaaaataattaatttactgctgagactagattattgatatgaatttatttattctgacagtcatcgattgtcagcgggcgattttaaaggaagttcgcctaattatctcagataacccacgtttgataacgattacacgaacaagccgggtttgtaaatatagttaacgttatacattattagcgctgttactgaccaaacaatataatgaaaatgtggtcaaaggagtcggcatttaaattaattaatcaatcgtacaaggttattgggggaggtcacaagtgatttagtgccagtaatttatgaattgttatgagagcaatcattgttgataatgaccaccgttcttagttgatgaaagctaaacaagcgctggtaaatgaaaaagggggatttataccatgaagccaatgttaggacacttattaatggcaggaactttattattagcgggtagtacaccgattgttgccaatgctgcagaaaatcgtagcgggaatacggatatcaaagcggaatttacgaagagtacgtccacggtgacgccagttgatccatcaaatcctgatgtgccaagtactgatggcgatggtgacaacggggcggcagcaggtggcgacctgtcgctgatttttgtgtctaaatcgttaggatacgggacgcatgagctggacgttttaaatgatcaacaatacaaggttgacccaactagttcatacactttgctatggcaggataagatggtcgtggaagtttctgatgttcggggaaccaatgccggctggaaattaacggttaccggctccaatttaacaggaacggatggtacggctgcaaagggcgcaacgctcagtttaccaaaaggtgacgtggtcaacagcggctcggaggccaatggtgcggttgccacggcttccgaagttgctttaaatggtacggtgggatcaagtgccgtcttaaatgccgataagggcggtggttccggggtaactgttagtcgcttagatccaaaggcgttgacactgaatattaaggctaatacggttaaggcgcaggcctatagcgctaacctgaattggacattgagtgatttaccaacaaattaagcgtcatcggggcgaacgggcgccccaagtacatatgtgagtaatgggggcgagaagatgcaattattgaagcgaatcatggtcattgtgggaacgttaattttaggcctgcaagttagcagcgttagtggattggcagccagtagcgcaagtagcagtagcggtaaaaccacgcaaagcaatgacatcgggtttagcgtggccgcgaagattccgaataatcagattgatcaacataattcctattttgatttaaaaatgacgcgtggccgacagcaacagattcagacgacgatttataacgtcaccaacgctgacatcaaggttcgaacggcgattcatacggcttatacgaacggcaatggcattatcgagtacgtgacaccaactaaaagttacgatccttctttgaagtatcgaatggaccaaatcactaaaatacagggaccaacgaccatcacgatacccgcaaacgggtcgaaagtggtaacggcgacggtcacgatgcctaagcaagcggtgaacggtgtgattttaggcggttggtattttaaacgggtcgccaataaagtcaccggaagtgttaagggttccatgaatattgccaatcagtattcgtatgtgattggactgaaatatactgctggtatagtgccacaaccacaattgaagctcgatacgattacggcgggcatgcagaattatcggcgaggggtgtttccacaattacgcaacgttactgcggtgatcgtccccaaactaacgattacggctaggttaacgagtaagaatagtggcaaggtcatcaagaactttacacagaagaatgtgcaattagcacctaactcagtttataaagtacctattttgacagggaccaatcgtttgcaggctggttcgtatcatgtccggctagttgctaaaaatgccgatcatcgatgggtgtttgataaagattttgtcatcagtacggccgcggcagataagtataatcaggcttccgttgataattcgggaatgagcgttggctggtttattctattcggagcgttaggcatgttaattattggattaatcggtctattaatctttttctggatcaaaaagcggcggcgtgcttagttcggtcagtgaaatgggggaaggaccatgccgaataaatggtggcgattaatattaggggtaatgcttgtgctgagctgggcaataccagtgcgggcggcaacacacggtcgcactgagatcagtgtggggttttatgagactaagtatagtgctgaccggattattcccgcccgtgtgattcctgatggtggtcacccgtacgttattagaccagctgacccgggtacccagggtcggagaaatcagtcagagcgcaagccaatccgccgacaactagttatcgatggctggttgcgggggcaatcacgcaatagtcaacaattgccccaaacaagtgagcggcttgtcattggcagtatccttggtgggatgggattgttagctagtgttttagcaggcgcgttgtaccgaatattaaaacggcaagatgggggtgaacgggatgcgtaacagacgagtaaaatggttactaattcttgtattcggtatactcggcttgctgaatttgctgctcttagagggtaacgccgcgactttgacgagcaagatgacggacgtgaaaactaatgctgcttttcaggccgtaccggctggtagttcggttggtagtaatattgataacggtttgcaaatgtatccagcattaggcaacgtgtctgctaactatgcggataatggtcgaattacgaggcagacgactcaaattacaatgacgatgacgggttcgattaccttaaaatctagtaactcgatgtcaaaagcttattttgatataatgactggtccggcgagtgggagctacaccggggcaacactagttacggctacgcctactagtcttggcagtggcaattcgattatgattagttcttcaaaacagacgcagacgttatcggtcaattttcaaaatattaaaagtgagttgccaatctatattggcttccgaatcacagtgaatggtgaggaaggtacctatcagctggggcgtttcaacgcgcagacattatctcctaaaattacggggacactttattcgactgatacgacgatcaaaggaaccgggacacccggcaatacgatcagtagtaatgttaatggtgtgacgacgacggtcggaagcgatggaacgtacacgctgaatcttgggactgcactcggtactttgagtaacgtcaccgtcactgaggtcgatgagattaccggtgataaggggacggcgaccgcagcggtgaccctcaaaaaactaaatattactagttcaaagacggcagtcgagctatatcctggtgacttagattcactggcaagtgatagcgcggtcgtcgcctggttagttaagcaagctggcatcgttgcgacaaatccggatagtgcgactgacacaattacttacgcggccaacgagactagtttagcgagcaagttgagtagtttagccgttggtagcagcaccacgatcaatatttatggaaaaggcagttctggactaaagtcggatgctaaggcaattactgtgacgatgcgggatggaacgttgagtctgggcacattaccagcaagtttgacgtttggcaccctgacgattccgtttaaagaaacactatatcagccgacaaatgcttggaacatcactgttaatgacacacggaagaccggttcacagtggtacttacgggcgacagcaactgccatgaaatccagtacgcggaccatgagtggcaacctgatttatctgaacgcggggaacaaacaggtgctgacgaatacttcggtaacagtcagttctggcaagaaaactgcgggtacgacaagcactaatgctgcaagtggttggtcgagcagtcagggtattttattggatgtccaacctagtgtgcaaattgacagttacagtgggacgattaattggaccttacaggatacaccttaaaaattaatataagtggtcaaaagatattgcaaaagtatgtcgatttgcaatgtctttttttatgaataattaataataagattgtaagggctttattatagtttaatgcaaatttatgtttacaatatagagtaaagggtttaatgaagccgtatttctgatatagtaaagtgaactaacaaatgtattaatatgatgaggtggttggcgtgtcagcagtacttttagcgctgtcgttgatttctggcggttatgaaatgttgtttttaatgattggttttagagaatatgtcacttggcggattgccatcatttggctaagtctggttatcattacgatgagcctgggggaagtggcttcaaacttatggccccaagtccccctggcttatttttggatcatcccgattgtttgtgtgaccacctttatgagttctcggttgttgtacacccagtggattttaatgttaccggtggcaatctttttgaatgcgcttaagcgattagtaggggcaatcatgggtgtcattgccaaggccgtagcccaatctgcatcgccaatgttattacggcaagcgataggtctacattcgacagcggatattaatctctttttagcgtcgattatgatgctgccggtcattattattttagggatgttagcgcatcgctggttagtacaagtgtcggccgccgatttcttgcaacgggcgcgtgttaatattagcgattacttattagttattttgttttttgctatttacattattgcgtatgtttttgcgatggaatggtcggtcaatgcgcaaacgtatatggcaattgcggccatcgtgacgtttggcattatcgggtcgtatttaattagtaataaaaacagtcacttgaatgatgcgcagctattgctacaagtctcaaattacaacgaattattaagccaccataaccgtgatttacatttgtttaaacatgattatgagaatattcttttgagcatgtcggcatttattcagaacaatgatatggccggcttaaagcgttattttacaacggaagtaatgcctgccagggtaacccttaatcgtcagtcgggactgagtgatttgagtcgcttggatatgccgacggtcagtggtctgatttatgcaaaatatgaggcagccaacggtcagaacgttcatttagtggtgacaatcttagagaaagtcacgttagcggatattccacagataaaagtagtgcggattttgggtaatttgctggataatgcgacggatgctgctgcccgagcgaatcatcaagtggcgctaactgttaaaaatcgagatgctcacacaacggtattttcgattacaaatcaaatcccaacgcatgaagcggtagatttatcagttatcaagaaaagtcgatttacaactaaaccaggacatttgggttatggattgagtagtattgaacaattaactacagatcaattagttgttaattattgtattgaagagggcaactttattgcagaactcgttatcaaacattaaacgttggcttacaatttgaaagaatttgattttgatcgcagtgctaacagcattacccaatattagtcaagtaatgacaagctgttacaattacgagacctgagcagccaaactcaaccgaagctgttactgccaccaaagatgagcgctggtcggagcatttaacgataagcttttagataattaagaccatacttttttcactttatgtgaattggttaacataaaaatgattgctttaaagcggttatcccagattacgagggataaccgcttttgtgtattgattgttaaataaaaaatatttgttagaatcattagtgtacagcgggattagttagcattgtaaattgtcagatggaaaatgtaaatagtattactgctagacatctgttaaaataagcattatttttgggttaacaaattttgaccaataacgtaaaggagttacagattatggggacagaactacaatttgtacaatatttacatcaaatgcgtgattataatgatcagcacccaaccaccaaggggctgatcttattaggttacttagaacgagattttattcgattttaccgggccggtaagattgaagaaggcattcaatttgctaagaagaatctgacccgttcgcgcgatttattaaataaattatcgagtgaggaaaaacagctgcaactcagtgcgctggttgatgtcttagcttttgagggaatccaaaatcatgctgagatttatgaatttgttaagctacgtaatgattatcaccgttggttagttaaattacccgtgacgacggaacgttaccagccactagttgtgcagattattcgtgattttgcggcaattgccaaaccgaacgcattagcttataacgcacatttagagtcaacgctcgatgtgatgtactataccaatgctcacctgcatgatcaactatcggtgaaaaaggtattggcccacgtcaatgcgcgttgcaatcctgaggcggtgcggcggtcgttcagtcaagagatgcatatgtcgattcgcgattacatcaatgctaagaaaattcaggaagctgagcatatgttgttggcaacggatttaactattcgagccattgctgctgaactctgtttctacgatgccgccgatttttcaaaacgattcaagaaggagatcggtcaaacgcccttagaatttcggcaacttaatacacgaactgattagtacttgtatttttaaagataacctttttcgcgtaaatacaaacccccgttttactcgcataaaagcaggtatactatgtctcagaattcaaaatatgtcgatatttgactaaaattaacagaggcaaattactatgcgatatacacggggcaaatggcgcgtaaccaatcccaaggtttggttgttttctagtgttttaattttaggttggagaattgtgccgacagtggctcaagcaagtgaagctgagacggttaccatgtcgagtcattcggtgcagttagaaacggatagtcaagaccaattaacagaagtagcacggatttcaaaaactgcggtaactcgtgaccgccacagtgtgaccgcccagtccagcaagtcagctgacaggactagttcggagcaatctgctacgactggcactgttgaggcggtcagtccaacgactagtgaagcccaacagcggtcaacacagcaagataaaacagctgttgaacaacaggcaagtgactcaacagcagcttctgcgggtgccagtactgatcaggcgtcagccgcaacaagttctgatcaggcgccagtagccaactcaactggcactcatcatgcgattgatatggccagttcagctagcgcactaggtgctgacagtggggcccattctgaaagtttatctgaggcgcaacgctcaggtggtcaaggtaagacgatcgattcagatttatcgggaactgttcattcacagtcatcagtgaataccgtgacgacagctacccctgtgaactcaaattcaagcctagaaagcgacaagtttgcttccacacggagccgagctgtagcggcaactgatcaaatgagcagcagggttgagaaaagggcattgaataaaacaaatgtcactaagtcaataaacataccagttgcaacaaagcagccgagcaagcaacggacagtcaccgcttcgtcgtttttgacaacagcaaagaacttagccgataggaactatcttgatcagtatgccaaacagcatgggcaagcggctttgattgctttgatccaagattggttgtccgcgtatcgaattattgcacttacaggaattacgattgtgaatagttcatttgatggtagtgtggctacgattagtggtggtctgcacgttatcaatacgggggcgacaattcgttctggtcaggatgatgaatgggagaccatcataaacggtggtttgtcagtgacaaacaatacaatcacgtttacaactaccaatggattggtggaccgtcccgtagctaatcaggatatggattttacaaagcctcggccaacaggaaatggtgcaatcaaaggtttaccaagcgttacggttgattcttcgttaatcaatgcgcaagaatttagtcaagcccagatcaatattagtgacttttatgatcaactagttactgcagggactattttatcggcaactaatggtggcacgttgagtaagatgctgattggtgagtctggaactgctgatttgggctcttatcaaggacaccattattatgccgtgaatattgatttgaatgactggcacagtggtattcggaccactggttttaataatgatgatgtggttatttataacgtcgtcacggcagcaccagcgttaaccattggtggcggtttttctagtagtacaccgaatctagtctggaacttcaatcatgccatgcgtattcagaataccacgatgataactggtaaaatcgtggcaccacatgctgtctttacaactaatcaaaatgttgattcagcggccgttttacaatatggatatggcgatggtgacagtgctattcgagagacgattacgagccaaaacgagcataattatggttttggtcaagtggttactgatgatccgttggattacttaattgcagtgattcagtcggatggtacgagcattgatactttagctggttttcgccatctactagcaaccgggcaactgaagatcacgattacagatgcggctgggacacgtttatcaaggttgaatgcagttgatacacatattgcgggccagcatcgctatctaatcacttaccaatttggcgatcaaactgcgacgacttggctgaacgtctaaccatcgcatgagcccataatacctatcagccggataccggaatattcagcgataacgcggacgatcaattaccaagatgagcgaactggggcggtgcttgctggcccagttatacaaaatgtacgggtcgtgcgatttgccatttttaatgctaaaactcatgaattgctcggctatgatacaaacggcgacggaattgttgatactagtgatgggacaattgcatggctgttagtactgccaacggatcaagattgggtacaggttgtctcaccagacttatctgcgcagggttatcaagctcctgatattccggtagttgcggggcaaacagtgatcattaatggtggtgatagaacgatgaatacaaatgtaattgtcaagtatcagcaacaaacgcatattgcaacgacgcagcgaacggttacccggacgattaactatatcgatggtggaacattgcaacccatcgcgtcactacatgctgttgttcaaacggttaagtatcaattattagctgtggttgctcatgacggaacgatacttggctacgataccaacggggacggacagattgagacacaattggcagatgaagcatggttgattgttggttcagggccgtggtttggcgcggttaagtcgccagatctgagccatgagggctacgtagcgccggacctaaaagtagtgccggagcagatggttgctggggtcgatgataaagatgttacgatcaatgtttattaccgactagcaactcaggccgttacggtgtatcaaaataaacggcgcgttatcagctatattgatcgacagacccatcaatcgattgccacgaccgtccagcaattggttatttaccaacgaacagcaattattgaaaaaaagactggcaaatgtttaggctatgatttaaacggtgatggattagttgatacgagtcaagctgattatgcgtggattttagttggcagtggtcaatttgccgcggtaacgtcaccaacgctagtcgtccaaggctatactgatccggacataaggactgtagcggctcaaacggtcgcgattactgatccggacctgatgacgacaatcgtgacttatgaccatcgtattattacggtaacaccaggcaatcctgctcgaccaggacagccagttgatcctgacaatccgaatatcttgtttccagatgagggtggcgacaccgatttaacgcacaccgttactagaatcattcactatgtttatgaggatggcacgacagccgcagcctcggtcctacaaaccgtccaatttcaacgcaatgcgatgattgatttagtgacgggcgaagtgacataccaagaatgggtaccagtctcggtaacggaaatggcgggcgttatttcaccaattgtagcgggtgccacgaccacattaacagaagtggcagcccagcaggtgagtgtcacaactgccgatcaggttatagtggttacttacaagaaatcggcaatcaaaccggaagaaccggggcaacctgaacaaccaagtcaaccggaagaaccggggcaacctgaacaaccaagtcaaccggaagaaccggggcaccctgagcaaccaagtcaaccggaagaaccggggcaccctgagcaaccaagtcaaccggaagaaccggggcaccctgagcaaccaagtcaaccggaagaatcggggcaccctgagcaaccaagtcaaccagaagaaccgggccaatccgaaaaaccaggggaactgcaaaaaccgagtcagccagctgattctgagcaaccagatggattaagtgatcaagccaatttgagtcgtaatcaggctgaacaatcacggacgtcacagccatcacaagcagagtcagatcaaagcgttgtgcagacgaatcagcagaaaacagctgcgtccgtttcaggtattggttgggttagtgcacaggcggtatcaaaacgtaccactaagcaccatcggatgacgacccttccccagacagacgagcagaatacgcaattatcactcttggggatgattggattagcattgagttcaattttaggttggctgaagattaagtcccgcgattaacagttgtgagatgatacccgttgtgagttgcggatctttaggaaccgggattgacggggttaatgttcctttgagggacagctagttttgaatgattaatataggcaatcactgacgtttcttattaaacggtagtgattgccttttatggtatcgtcgttggtacttttgatgcggtcagttgaccggtcaaaatggcgactaataactgagcaaaggaacacacgcggcacttttcgtagtgacactaaatgtcagacatatgatagtagcaactgggtggggcgtttaaaaaattaagggttatgcctaaaaataacatttatcgttgacaattgtaaacgaagggattaatatacacatatagattacaagtgtaaacgataatgagaaagggacgaataaaatgatgattaaagtattagtcttattaattggtgggttagcaattgggtttattctgtggtggttcttcgggaagcatgctacgacaacggtcaccgcgagtgcggttgatgatttacagcaggttgatgtggaggttaagggtggctattcgccagagcaaatcgtgttgaaaaaaggggttccggcggtacttaattttacgcgcaaagatgcatctggttgtctggatcacgtggtgttcagtgatttcggtatcaatcaggaattgccacaaaatcaagttgaagcaattacgattgatacgagtaagtctggcgaatatcaatgggcctgtgggatggacatgtttcatggaaaattaatcattaaatagtgggaggaaaatcaaatgagcgcacgacaacaaatcaatattacagtagacggccattatgacccagcagaagtaacgttacaacaaggtgtaccggcccaattaacgtttacgcgcacgagtacgcaggggtgcttagagcaagtacattcaaccgacttgcactttacgactgagttaccccttgaccaaccgcaaacggtgacggtaccaactgatcgagccggtgaattttactttagttgtgggatggacatggtgagtggcaaggtggtgattgcgtaatgaacacgacgaaacggttttggatttcattaatattttccctgccactactggctaatatgattttgatgccctttggctggatgctcccgggtggtgattggacgcagttgattctgacgaccattattatggttgtttcggctcggccgttcttgcaaagtgcgtgggcgtcctttactaagcaccatgccaatatggatactttggtggcgattggcaccgcgacggcttatttttacagcttatacgcaatggcaacggggcaagcagtcttctttgaaagtgccgcacttgtgaccactttcgttttgctcggccaagtctttgaagaacgaatgcggcacaacgcgtccagcgcggtcgcaaagctagtgggcttacaagccaaggaagcggaagtgttacgcgatcaagaatttgtaaaagtgccgttggatcaagtagtggtcggcgacattattcgggtcaagccaggggaaaaaattcccgttgatggtgtaattacaactggccgctcaacggttgatgagtcaatggtgacgggagaaagtatgcctgttcaaaaaacggtggcggacgctgtcattggttcaacgattaatagtaatgggacctttcagttcaaagctagcaaggtcggtgaccggacaatgctggctcaaatcgttgagctcgttaaaaaagcacaaaacagtcacgcaccgattcaaaagctgaccgataaagtttctgatatttttgtgccgattgtgctaattattgctatcgttaccttcttgacctggtatgttttcttgaatgccagtctcgcgaatgccttgatttttgcggtcgctgtggtcgtgattgcctgcccgtgtgcgctaggccttgcgacgccaactgcattaatggttggtactggtcgtggtgccaagatggggatcctgattaaaaatggtgaggtcttggaagccgtcaatgacgttaaaacggtgatctttgataagacgggaacgattacggttggttacccacaagtgaccgatgttatcggcgacgaagtccaagtactgcgcgttgccactagcttagaggcggcttcggaacatcctttagctgcggcaatattaaaacgcggcacggcccgtggtattcaagcaccaaccgccacgaacttccaagccatcgagggtaaaggtgtgactgctcaagttgagggccaattagctgtggtcggtaatcataaattattaactgatgagccgattagtgctgaattacaacgccaagccactgaacttcaggacgcggcgaaaacggtcgtgtacgtgggcttaaatcacgaaatcattggattgattgctattcaagacgtcgccaaatcgacgtctgaggcagccattgcgagtttgaaagcacgtggcttgaagacggtcatgttaaccggtgataacgaacgagtcgcacaagctgtggcggatcaagtcggtattgatgaagtgattgctgatgtgctgccaggtgataaggctgatcacgttcacgcgttccagaaggctggcaaggtggcctttgtcggtgatggtattaatgatgcccccgcgttgacgacggcggatgttgggattgccatgggttccggaactgatattgcaatcgatgctggtggtatcgtgctcgttaagaacgatctgcgcgacgttgaccgggcgttggcattgagtaagaagacgtttaatcgtattaaacttaatctgttctgggctttcgtgtacaacgtgctcgggatcccagtcgcggcgggcctcttctttgccattgggctgacgcttagccccgaattggccggattagcaatggcctttagttcattgtccgtagtcacgagttcggtattgctaaataaagctaaaatcagttcgaacgcccaacctgcgtagacgatgacaggtagcgtcggatgaaattgggcctgttaaacaagcagaaatgtgtgttaatggtacaaaatatgcgggtgtctaacgccagttcacgttgttgagatggcgttagacacccgctttttgagtcgacaatttaaggaagaaaactggctataaattcctcacaatcagtaaaaaaagagtattagatttacactaattaagtatcatatcgttagtgtgaaattagaagaatgcccatttaacggagataagtgtggtgttagatacttttgtaggcgcttgaatcaaattgtgtattgtgtaacaatattaattgtaagcggtttacatactatttgaaacgagggtttgaacatgaaaattaaagcagcagtggttgataaagtaaacgatccatttgtcattaaagatgatattgaattagctgaaatgaaagcaactgatttacaaatcaaaatggttgcgactggaatttgccattctgatgaagcaattcggcggggtgatgcgtcgttaggttatccagtaattttaggacacgaaggttctggaatcgtcgaaaaggtcggttcagaagtaactaattttgaagtgggcgaccatgttattctatcattttacgctgacggaacatgtgataactgtctgaaaggcatgccaactaaatgtcggaattatgccgactataacttgagtgggactcgtcccgatggttccgaccatttccaagaaaacaggcaccatatcagtgatatgttcgaccaatcttccttcacgactcatacagtagttgaccaacgtaatgcggttaaagtaccaaaagaactagatttacgtcgcttgggacctttaggctgtggctacgtcaccgggagtggcactgttttgaacagtttacagccgcgcccaggacaaacaattgcagtctttgggactggtgcggttggtttagcggcaatgatggctggtaagatttccggctgtaccgaagtgattgcggtcgacattgttgattcacggctagaactcgccaaagaattaggtgctactcatgccattaacagtaaggaagaagatccagttgaagcaatcaagaagttgacgcatggttacggggtcgactttgccgttgatacgactggggtagaaccagttatggtttctgcaatccacgcacttgctcaaggtgggacggctgctttgattgccgttacggccaaaaatatcaccattagctcatggaacgatttgtgtgttgatgataagaaagtcattggtgttaacatgggtgatgccatccctggcgttgatattccacggttaatcgatttctatcaacatggcatgttcccatttgaaaagaccgaaaaattctataaatttgaagatattaatcaagccaacgctgattctggtagcggtaagaccatcaaaccagtcttgatcattgatgaagactatcaacctggtaaatagctaccggcttggtgccaccagtcatgcggactggtttctaaaacggcaatgtcaaaagttgattttgacattgccgttttttacgttatacacccgccacttgcatgatttgtgattaaaacatgctggttcttaagttcaagagcagccagcttaggcccgctggaaactggtgcgagttagcgtaaacttgcttagggtgcgcgtcctacaccgacctccaggcatttctgccaattgccggaacgtggtgggcacagatttaagccgaagcccacgtcttaaatactggcctttcactaaccaagcaaagaacgcttgctaagtgaaatttcaccactgggcattgtcagaaacgccttccagtcgggacagtgttcgaatggcagacggcgatgtaccaacttttgatgaattagtcgttgttcttcataaaacggtaattttatcaatcaactgtcagactgaaagtgatattgagatagctcaccaactctgaattataataataagattgaaactcctgacaaagtgccttatgcatcctaaccctttgtttaaagttccattatcaaaatagtcagcgaccaattgtaccaagttaagtggctgttcatcagccattcgagcggcttaccgactgtaggggctgggtgacaatgctcagtagccaaattattcttagtcggaagtgatttccttccggcttagaataagactcgtatttgagatgacgcgggctatgcgttagctcaaatcgacgtcggcttacgttccagcaattgtcacccagccccggaggttggaataggacgatcattgctgacgaacaggaatccacctaaccagcacgttttaatcacaaatcaggacaaattaatttgcacaatgtgtgttcttatctgtgcttgtcggtttattgttgctgtgaatgtgggattacttggcatcatatgcggcttggaaaatcttgatgatgtcttctttagtgcctttgcgggggttggagaaggcgttgccgtctttaagcgcattagttgccatgtgttcgaagtcttcgattttggcgccaatttccttgatggaatgcggaataccaacgtcttcgctgagctgtttcatcgctttgatagctaattcggcagcatcacgagtcgataagccatcagtgttttcgcccataattttggcgagttcggcgaagcgttcggggcacgcgattagattatattcttcaacgtagggtaagagcagcgcgcagcagacgccgtggggtgcgtcatattggccgccgagctggtgggccatggcgtgcacataacctagattggcgttgttaaaggccatgccggctaacatttcagcttcgaccatgtgtgttcgggcctctaggttatgcccattggcgacggcttcacgtaatgatgtttcgattaatttgatggcctggatgcactgtgaatcggtaatcggattgtgatcgacagaaacaaagggttcgatagcctggacaaaggcatccatgccagttgcggccgtgagtcccttaggaacatctagcatgagagtgggatcgttaaaggacacgagtggcatgttacgccatgaagcaacgacgaacttataatgcgtttcttcattcgtaatgacacagtgacgggtcaattcagaaccagtcccagcggtagtgttgaccgcaatcagtggtggtagggcgttcttgagcgtttcaatccccgctaacttagtgatgtcgtcgccgttagtcatgatgatgccggcaccttttccggtatcgtgggcagaaccgccgccaatggtaatcagggagtccgcttgattggcttgatataaggctttaacagcttgaatgttatgaattttagggttgggttctacttgattataaatcacgtagtcaatcccggcagcatccagtgaccgccgcacctgagcaacggcgccgtctggcagactttcaagaaatttgtcggtgacgatgactggtttgtgcatgccaagagttttggcacgctcgccgattttactaatgacaccaggaccgaaaaagttaacgctaggcattaagaaatcaaaattacgttcagtcatattaataacctctttttatattgtaatcgctatcattactaatttacgaatcaaattatagtcgtaataattacaatttgcaatactttttgactaattaattatatttttcacaatatcgtttaggaaaggtgcggcgatcacggcacacctgttgtaaccaagcgttaattgacgttgaattacagtcctcatgccatttgatattactgcctacaaaaagacgactaattacaaagattcacaatcttagtaattagtcgtctttttagtgtgatccaatagaaaaattgggttagtaccagtgatgatgttgccagaaccgtttggccttgacccaggaaccgtagcgcgaggcaacgtaggtattagcacgtttttcctgattgacgggtgacaagttgccgtgtaagtatgagcgcaacaattgatagcgaccgtagcagcggccattacgagccgtataactgtatccagattcacgataggcgatccaatttttggcagcgcggttggctttcgaaagcttggcgttgatcttggcaatttgctgggcttggctaagcttcttggaggcctgggcggtgattgtggtttgtggtccaagactagtagtcacgttaacgacgaccccgaagacacaactagccaaaactaatagcaacatggttttaaagttaaattttttcatgatatgtataaccccgttttatgttttcctaagctgataagtgtagaatacgccaattatgtgtcagctatgttaaagaaaagttactatgttattaaatgaacgtttccattatgaaatagtttttgtcaataactgttgcggcaattgtttagatgaataattgcgctgactatcacatgaaaaaatcataatattgttaggaaaactaaagcgctttattgccttcgttcggtaatcttaaattggaatagctttacaaaagtattaaaggagtaagtgagggagtgcaataatggcaacaaaagataatgaaaagattacattgatggcgctagtcatgatgatctttacgaccgttttcggatttgccaatagtacggtggcctattatttaatgggttacagctcgattctattttacctagtcgcagccgtactgttcttcatcccgttcgcgctaatgatggcggagttcggggcagcggttaagtctgatagtagcgggatgtacaagtggctggaagtgagtgtgaatgcgaaattcgcgttcgtgggcacgttcatgtggtttgcgtcgtacatcatctggttagtctcaacgtcagctaaagtctggattccgtttacgaccatcttctttgggagcgatcaaacgcagcgctttgcgatgtttggtctgaatgcgacgcagatgattgggattctgtcctgtctatggatggtgctggtgacgttcgtttccatcaaagggatgaaaggcattgtgcgggtcacgagtttaggtggcctggcggtgaccagtttgacggcaatcctgttagtggtttcgggggtcgttttagccttgaatcacggacaattcgcacaaccgttacaacatgtgatgacgtcaccaaatccaagttatcagcatccagtcgggttactcgggtttgccgttttcgctatttttgcttacggtgggctagaggttctcggtgggatggttgataagaccaagaaccccgaaaagaccttcccacgtggaattattatttctgccatcgtcattaccttaggctatggcctgggaatcttctgctgggggattagtacgaactggcaagccgttttgtcgaatccaacgactaacctcggtaatattagttatgtcatgatgcaaaacttgggctatgttttagggcaagcgcttggtttgagtacagcggccgctaagacaatgggactgtggttcgcacggtacaccggcttagggatgttcctcgcttacagtggggccttcttcaccttaacttattcaccattgaagacgcttatcttgggaacacctaaggaactgtggccgaaaaaatttacgaagctcaacaaagctggcatgccaagttatgccatgatggttcaatgtgccatcgtgattgtgatcatcttggtggcgtcctttgcaacggcagacgcgtcagccttttacaatgtgttgaccttgatggcgaacgtttcgatgacgttaccatacctcttcttgctatacgcgtttccgaagtttaaggaaaaccagaacattgttaagccttttgaagtgtacaagtcattgacttggacgaaaattattagttgggtcgtgttcattgtcgtcttaggcgcgaatgtcttcacgttgatccagccaatcttggaaactgggcagattcaaaatacgatttggatgctagttggaccaattgtcttcggtgtggccgggattatttggtatcaagttcgagaacggcatgtcaattaaataaccaatttcaaaataccattcgattgctgactgataaaacagcattgaatggtattttttaagtgccttaatatgggaaatttagtacactcattagcaaaagctatctaggggggaatggtcatgacattgggaactgcgttaaagcaggcacgcaaagccaagcaactcaatcaaaagcaagctgcccgggaaatttgtgcacaatcgatgctgtcagcaattgaaaatgatcgctacgtgccgaatgcccggctattactggcgctgtgtcagcgattaggggtcgcggttagtacgttgagcctagccgacgattttgagatcagtgccgagcaagcgtttaatgaccgcgttcggcagatgtgcaatgcccatcagtatcagcaattgaaggattggctattacagccaaccactttggaacatgttcaaacggatgaacagactcaggcttactattattatctgggtgtcgcctgttggcaggttgatcgcacatcggatgctgcacaacaaaatttacggctggcaattggtatggctgctcccagctcgccgccgacaacgttgacacgcttggccttgatttcgttagccgtcgttaaggcgcaccaccatcctcaagccccagtcgcggccttagtcacccgggcactcgctgacattgatgcgagtgcatatgaagaaaatgccaacattgttttttaccttgctgggttggtggcctatgaacaacatgattcccagttggcggtggcccgtttgacgcaggggttggcctttgcgactacacacgattcacactacatgctggccaatatttatcagttgatggcgcaactcgcaatggcggcgggggagactgccacggcgcaggttgccagccaacggtcacaagttttcaaagacctgtttaaagaacaaattaacgaccgcctgtaaattatcagtattctgattttatgttggcgtccccatcgtgtattttataagcaccaactaaatacatgtgcacttgatctaacggcccgttattgatttggagtggttgggcgtaataacgatgaccgggtcaggatgaacattgggggttataaaatgacaacagcattatttaccaatcaagtattaacacaggcaactccagcaacggtgcgagcattgctagcagatccgctgaacttaccagcatgggcgactgccattaccacggtcaagccaaccgcgacggggtacgtgttacagcggtccggttcggcttttgatcagccggaacagttgcaggttacagtcggcgctgaccaggtcgtttatcacagtgaggggggccaattgggatatgaaattgtgttcaccatgacgccattggccaatcaaactgcggtccaggaagaagtctcccttacgactacaccgccgagctggctgccgttgccactagtgaagcccgtcatgcaacgggactttcagcggaagttgggtcaattggcaacattagtggaggaacagccgaatgacgattaatgatgggatgacgttaataaaagtgttagtgacgtggtggtctgtcagttggttattacggatactagtggttggcggcttagtggccgtaatctatcaacgttggcatcggcgtaagtattgagaaagcggggtactttgagtggcggctgtcaacccaaggcatcccgttttcttaattagtttattcagaaaagtctttgtttttcaaatgcacggcggtcacaattgctagcaccgcggataagcccatgacaatggcgaaggtcagagggctgtcttcaccagggaggccaccggtattcatgccccagatacccgttattaaggccggaatcgaaataatcaggcccgccgaatcaagatatttcatcaagtgattgaggcggttgcccatcatatcggaaaacaagccaccaatggtttcaagcaggtcacggtaagttttgaccagcttattcgcatagcgttgttgcaactcaatctcgtattgtagcgcctcgttgttcaattgtttttgatatttgttattgtgaaataattgatcaagggtggccgcttggtcttgtaacgtttggtctagaaagaccatggtgcgttcggcagtggccagacggaatagctcagcgttgcgagtcgtctggcgcgctgcgtcatccaactcatcaatggttgtttttagcgccgtaagttctttgacgtagtgttcataaatttccaagatggcgtagctgatgagtaattcgttcgatgagatttcggctgcatgctgtgcgagtagccgttcaatgaaggttgaatcgtgacagacgtaggtgattagaaattgatccgtaatgatgaatgataaaggttctaagcgggtctcaatttcgtcgtccgtatcggctgatagattgatcagaacgagcgaataacattcccgaaagcgggtatgcgtcagcttttttaactctgaaacttcaacactttgattcgcgttcacaaaaatatcaggcggcaattcaaagttgtcaacaacttggtggacttcttcgtcagtagcatcttgtaagacaatccaattggcgttttcacgagttgcttcggtgataccactggtgcgaagctggtaatgctcaatcatagttgcgctcctttcgaaattctgacagacaacaatagttcttcacaacgccgtattatgccaagtatggggctgggtgtaaagtgaaatactaatcaaaactataaaaaatttcatgtgcgtttggctgttattttgacggcccatccggtatggtggtggtattcaaataaaggaggccccaaaatgacacaaccagaattacgtgacccacgcgaattatataagacagatggttttgataagcaggatcaggagacacccgcactacaagctaagatgcgtcctgaacccgattgtggtgagaagagttaccaaggacatgataagttgttgaatcgacgcgttttgatcacgggtggtgattcgggaattggccgggccaccgcgattgctttcgcgcgggaaggcgctgatgttgcgattcagtacttgccgggagaggagccggatgctgaggcggttgccgaactagtgcgcgttgccggccgtcaagcgttattattaccttgtgatttcaaggatgttgacgttgtgaccgacctcgtggaccggacaatcgctgaatttggtggtatcgacacccttgtcctaaatgcggggcaacagatttcacagccttcactggctaagctgccgatcgaacaggtgcgtgcgaccttcgaagtgaatatcgtcgcgatgtttgcgttggctcaggcggccttgccaaagatgcccgctggcggtagcatcgtcaccacgacttcgattcaagcctatgcgccgagtggtcatctattagattatgctgcgactaaggcggccatcaagaactttacgattaatttagcagccgaagcggccgaaaaggggattcgggtcaatggcgttgctcccgggccaatctggacgcccctacaactagatcaaggccagccaatcgaggcgctgccgaaatttggccaagacaccttgctcaaacgagcgggacaacccgcagaactagcgccagtgtacgtctttttagcttctaacgacgcgagctatgtgaccgcgcaaatttatggtgtgactggtggcggcgtgattaattaggtgttcactgcaagttaattcctgattggcttgaataaatcataagtggctaccttggatggatgcattcaaggtagccactttagtgtgtttaatgatctgatgaggcgttcattaagtcgtccagcgctgccgttcccaccgctttggctgcaattagtaaacagtcttcattcatcataaaatcagggctgtggtgcgggtgggtctcacccggagttgtttgacagccggcatagataaaggtgctgggtttggcttgtgcaaaataggcgaagtcctccgaggggtcttgggggccgcagtcgaaaattttagtgatttctggaatctgagcggcttgaatactagtgatgacgcgctgtgtcagggttgcatcattcatgagtaccggataattatcatcgtaatcaagcgcaacttggacaccgaaagtcgccccgataccgttcgcaattttagtaatctggtcacggattgtctggcgcgtggtttcgtccataatccggacatcgcccttgagggtgacttgcgctttgatcgcattgaaggaaccgacgccgtcgaatgagccgatggtgacactgccggtatcaaacgggtcaatccggcgggaaacaacggtttgtaaggcggttacaaagtaacttccagcaacgattgcatcgtttgagaggtggggcatcgaggcgtgcccacccttacccgtgaaggtgaccgtaaaattagcccgcccggtctgcgtcgcatttaagtgataggaaatcgagcccgtcggcatggtactcatcacatgcagcccaatgacgttatcgatgccgtctaggacgccagcagccaacatacccttagcaccacccggtgacacttcttcagcgggttggtgaataatgcggacgcgaccacgtagctgatttttcagtccgagtaaggtcttcgccagtaccatgagataagcagtatgaccatcgtgaccacaggcgtgcatggcattggcgttttgcgatttaaatgataagtggttgtcttcttgaatcgcgagggcgtcaaaatcagcgcgtaatgctaactgaggtccagggtgaccgctatcgatgtcgacgacgaaggcgtacccatcaccataagcggtggttgagacgcccaattcacgatagaacgctttgatgtaagctgcggtttgttcttcatgaaatgaaatctcggggtgggcgtgtaagtggcgacgaatcttgatcatttccggttccgccgccgtgagttgttgcatgagttgtgcttgaagggtcattagaatattcctttctgatgctagaagcgagtatattataaagatagctgagagatgatagtactgcactaatctttagcttagcatgaaatggcggttaataggtatcaatgtaactatggaattttcggacgctttttaagtagtggataataactaaaaggaatattctgcattgctcatgtcctagtaagatattagatagccgctccaagaatcgtgtctgcaattcttggagcggctattttttagtcgattcaaacatatagtgtttcttaataacaacgttgaaggcgcttttgtgaaagcttagaagttcgtcacctgtttgatattaacctttaaaggtggtaattgaactgcctgactggtttttttattcgtaactctctgcgtgacagttaagccacgggtgctatttttgatttttgcatttggaataaatacttttgtagtcgcacttgcgttcttgatggttttaattacttgaccgttttgtgcaatattgatggttgcatctcgagaaccgataagtgtgtaatagatacctttggttgttcgctcggcactagtgactttaacctttggggttgcgtattgttgggacggaattgtggctagcacctgttgccctttcattaatttgaaatctccgtagcccttaaactgctgtgcaaacttgaattgtcctgatttgacgttgacggttcgaactgttttgccttgataagttagcgtgaggtgttcgattccaatcgcgcgaccctttagtatcaaggagtgtgattgtgaactgtaattagttgtgatatttgtaatcttaggttgtacatgaagatattcggttacagtgatgatttctccgggattatttggaacactatcaaaagtggtagtcgtggcataacgagccttcataccattaatatcgcaggcttgaatagtatagtaccggtttgctggattcattacagatacactatcagtattattgtgtccaattcccagagcatgacctaattcatgctctgcaacatttgtacgttctgccttggtataattatatttttcaaatgccgctcggttgatgcgaactttgcttgaagtgatttcgccagtagatttattataggaaactgaattgtagccggccagagtcatgtcagagcttccatcatacgaagaaacggtggtttttgctgtagctgctttcgtccacgtaaaaccagcctttttccaagaagcagttgcgttgttccatacatctttatagtagtcggaggatgataaatcttgatagtttgccgcttgtttatcatatcgataacctaacatcggagtggtagcttttgttgatgcgttggcacttagaagtccaaaactagttgtcaaggaaatcgtcgcaagtgttgaaaagattctttttggaaagcgcattgtaagttcccccttttaacgacatttcttatagatgaaatgaattgaacggcgggcaaatatttgcaatattaaacgacaggtagtatcaattttttctcgagatgaaaattgatgtttataaatacagaaggcataatgcgatttgtatttatttagtacaagtattatatcatcttggatgttccgtgaaaaaaatactgtatagtaaataacttatactaatttttaagtgctttatataaatcaatttgtatctttacataatttatcagagcggaggaaagatatttctcccacacatactgaattattatcatcgtaatctgtttttgcaaaagatatgatatattgattgtcctgactgttaatttcaggtaccctaaacaggagaccacaattatgaggaggaacgattgatgaagattttgatgccatattttaagcggtatcgactagacgtctggattgcgatgctgtcggtcatcgtcttagtgtttgcgacgttatggcaaccgcgattattgcaagtcattatggaagccattatcaagaatgatcaggctacggtattccgtgaagggctgatgttgcttggtttggccgtactgggaatcattggtgggatcgtgaatacgatatacgcagcccgggtggcccttggtgtggcgaccgacttgcgagctgacctatacgctaaggtccagtcattagcctacgctgacgtggaaaaattttcaccgtccaacttagtggtacgaatgacgaacgatattaatcaagtccaacagattgtgatggctggctttcagcagattacccggattccattactattcatcggggcactgattctcgctgtgatgacgatgcctgagcagtggtgggtcattgttgtcatgatggcggtcatcttaggggtcgcactgattgcagtgcggcgaatgactaaatactttgcacaaacgcaacaagatattgaaaacgtcaatacggttgctcgcgaaaatttaatggggattcgggttgttaaatcgtttgttcaagaaccaaacgagatcaaaaagttttcggccgcatccgatgaattaaccgctgtgaccgctaaaatcgggtactggttcgctattctaatgccggcgttctttttgacggccaacgtggcggtcggggtcgccgtttacttggtcggacaaacgattacgacgcacccgtcctatttagcagctattacgagttttatttcttatttaatgcagattttatttgccgtgatcaacgggggctttctcatgacttttgcgtcgcgggccgtcatttcacttggtcgaatcggcgaagtgatgactaccgaaccaagtatgacctacgttaatggcgacgcggcgcccgtagctggtgatattcactttgaccacgtaaccttcacttatccgggagatgcgcagccaacgctaaaagatgtgacctttacggtaaaagcagggtccatgctgggaatcgttggggccactggatctggtaagacgacgttggcccagctgattgcgcgcttgtatgatccggatagtggaacggtctccatcggtggaattgatgtgcgggccttaccagaaaaagcccttcgatccacggtggcttatgtcttacaacggtccacgttattttctggcacgattgcgggtaacttacggcaagttaagccggacgcccagcctagtcacatgcaatgggcagctaatattgcgcagtctgcggaattcattgaacggttgccacagacgtacgatgcccccgtggaagaacggtcacagaacttttcgggtggtcaaaagcagcgactagcgattacgcgtggcgtaattgccaatccagaaatcttgattttagatgatgcgacttcggcactcgatgcgcgttcagaaaaacttgttcaagaagctttggatcgcgagttgaagtcaacgacgaccgtggtcattgccgaaaaaattgcttcaattattcgtgcggatcaaatcttagtgttagataatggtcgcatttcgggccaggggactcaccacgaattgcttcaagatagtgcgatttatcgcgctatttaccaaacgcaaaaagcacgggaggagggcttacatgagtgatttacgcaatgctggtaaatattactggcactatttaaaacgctactggttaggcttcttactaagtgtgattctgattgccttttcgacttggtgcattgtggtcgcaccgacttatctgggacgagccgtggaggagctgacgcagtacttgcagcagtggacgaatcaagcgactcgggcacaagcaagtttgcaaccgttcaaccggaccctgatcatctacgtcttgttgtatgtcggtgatgctagcacgatttttattgcgagcttgatcttagcacgcgtgacggccttttcgaccgggacaatgcgggtgggcctatttcggaagatgcaacggatgaaggttcaatactttgatacgcatagtgacggggatattctggctcggttcacctctgacctagataatatttttaatgccatgaatcaagccttgctagaaattttattagccgtggcgcagtttgttggcctgctaattgtgatgtttaatcaaaacacgacgatggcgtgggtgacgatggcttctacaccggttgcattaattatcgcggcgtttgtcatgcacaaggctggcgtcgcggtgaaccaacaacaggatgatatcggtcaactgaatggttatatcaatgaacaaattactggtcaaaaagtcttgattaccaacggcttacagcaggactccttgaaaggctttcatcagtataatggtaaggttcggcagtcagcattgacgggtcaaatctggtctggtattttgaatccactgatgcaagggatgtcactgcttaacacggcaattgtcatcttctttggctcatggttagcgctgaatgggagtatgtcgactggggcagctttggcgctggtcgtggtgttcgttaactacgcccaacagtactaccagccaattatgtcattgactagtttatatagtatgattcagttagcgattactggtgcacggcgggtcgatgaagtccgtaatcaaccggatgaagtgagccccgctaacggtcaagcgctcgacgggattcatgatgaattactgattgataatgtgcgctttagttacttaccaggtaaagaaatcttgcatggcgtgtcgatccatgtgcaccgcggtgagatggtggcactcgttggcccaactggttcggggaaaacgacggtcatgaatttgttgaatcgcttctatgatgttgatagtggtgcgattacgtttgatggggtgaatattcaagactttgatctccaggtgttacggcaaaatgtcgggattgtcttacaggaaccccagttgtttacgggcacgattgcggataatattcgttacggggacccaacggctagtatggatcgggtcatcgatgcggcgaagcaggctaatattcatgactttgtgatgagcctgccagatggctatcagacgcgcgtttccgacgaacagagtattttttctgctggtcaaaagcagttgatgtcaattgcccggacgattttaacaaatcccaagttgctgattttggatgaagcgacttcgaacgttgatacggtgacggaagccaatattcaagccgcaatggacaacgtcatccaagggcgaaccagctttgtcattgctcaccgcttgaaaacaatcctgaatgccgataaaatcgttgtattgaaggatggtcaaattattgaacaggggaaccaccatgatttattagcggcaaacggcttctatgcggaactgtatcgtaatcagatggtctttgagtaatgaaagtataaggagtcggacatggcagggcaagagcaacaagtgcgggtttcaatcccagtctcagcattaaaacgagccgggattgatcgcgatgatcagttacagttaaaggtgcgcaatgacgcactagtcttagagaagattaagccacgtcaaccacagtggcagcaatacttgataatctggccgctgttggttgcaatcctatcggggttagccagttacgggtactggtggtttcaaaaagtgcgaccagttccactgacaggtgcgcaatcaatcgggagtttgacgattgtggccggtgtggttaccggcgcagtgctatttgtcggctttttcttaaaaacgcgtaatgatccagaaaatcgattttcgcgccatatttattggcggaactttccagttattacgattgcgtttattatgatcttagcctttgcgctggtcggggctttctgggtattagaattattatttccagatgtcatcttcgatcgctttacatctatgttgctactggtcttgtttacgtattttgcggatgcgttcatgattagcgctgcgttgacgataaatgcgcggtcgttatcaacgattttaacggtggtgattgtcagtggctgtgttatctcaatggccgccaatggtcaacggcgatggtggcagcataatttaagctttttagggacgcatgccgctgaaaatgcctggcaattcaacttgacactgattttttcggcgttattgatggtcgttctgattgactatctatttgtttcacttagtcgaatttatccgcgtacttggcgaacgtcaaccttgcggatattgttgacgttgaccgctgtcgatttcggggcggtcgggctatttcctaacaacctgacgtttcactggttacatgacttagttgctggtggcttggtcacgttgttagtcttgttgattgtgggggtgcggtggctattaccagccgtgacgaaagattttctgtggctctcatacggcgttggcgtggtgctattactactcaactttggttttcgctggttcgggtacccatcgctgacggcatttgagattcaagcctttgcgatttcgtttggctggttgctgatgctattttcacgtctacaagcgttagtcaatgaagacccggaattgctgacgattaagttggagcaggaaagtacggcagggcaataagttttatttcggcagatattgttttaaatattgattgctgatatgcaaaaagaggttatgccacatgcgtcagtgtgtggcataacctcttttgtgaaagttaagaagcgctattatggctggtattaagcaccaagttcccgggtaagaagacggcagattttctacatgaatttacgaagttggtcccgactgaaacgcagagccactcataaaatgacattaaaaaggcaactgttcgtggtcacggtacgtgctggtgaacgggtgcctttttggggcttaagtctaatttgaagtctgcaattatttgttaacggatactggcattcaacccgattttaatttataattagttaaaagaacgtatgttcttttaactacaagttattgaatcaggtttcatccaaaagtgagtgtcatgggggcgagcgacatgcggctatcgttaaaattcgatcagcagcaacatgagatttattttggattaccagcaaaatgttaaggtgaacaacgactgtgattgtgccgattaattggaagggagtcattatattgatggaacagcgaacatacatggcaattgacttaaaatcattctatgcctcagtcgaatgcgttgctcatcaactcgacccattgaatgccaatttggttgtcgctgatacgagtcgcactgataagacgatttgtttggcggtttcgccagcactaaagcaatttggtgttccagggcggccccggttatttcaagttgaacaacgggtcgcaactttaaatcgcgcccgtggtcgtcagacctcctatcaggcggttcggcggcatcgctcaatttatcgtgatcagctcctcaagcatgctaatttgggtatcgattatcgggtcgttcccccacgaatgagttattacatgcagaagagtgctgcgatttatgatatctatttgcgcttcattaagccggaacatattcacgtgtactcgattgatgaagtcttcatggacgtcacagactacttaagtacttttcaggtttcaccgcacgcactggcaaagacgatgattcacgagattcaggccgagaccgggattacggcgacggctgggattggtgctaatctctacttagctaaggtggcgatggatattgttgccaagaagattcccgctgacgctgacggtgttcggattgcacagatggatgagcagcaatatcggcaatacttatgggcgcacgagccgttgactgatttttggcgagtcggtcatggctatgctaagcggttggcagccctggggctcaatacgatgggtgacattgcgcgctgttcactaggaaccttgtcggattctcataatgaagaacaattatatcgtgagtttggtaaaaacgcggaactgttaattgatcatgcgtggggctgtgagtcgacaacaattgctgacatcaaaaattaccatgctagcgaacatggtatatatgccagtcaagtgttgatgcgaccgtatacttatactgaagggcaagccgtgttacgcggcatggtgaataatttgacactcgaactggttgctcgccacgtggtgacagatcagctgggaattcgtgttgattacgatgctaatgcttcatcagttggcacgcattatcagggtgcggtcaccgaagactactatggacgacaagtaccaaagcccgctcataccaaggtgacattagcgcaggcgagtgcttcacaacacgagctaggggctgcgtatcagcagctttatcaacaagttgttaatcgtcaattgatggttcgacgtgtgaccgttatggcgaaccatttggtcgacgaacagcaggttaggcgccaacctcggtatcaacaaactaacttatttgaaaatccagaagtggcccaagcgcaagaacgagacgcacaacgccaacgtgaacgcgatgggcaattgcaacgcgccattttgaaattacaacgtcgttccgggaataagaatgtcgtcattcgcttggcagatctaaaaccgagttcaactacgattgaacgtaatgagcagattggggggcatcgtgcctaatgacaaaggaagccagtactactgcgttatttaatgatacgagtcgctatgcggatattttagagtgctcgcgacctacttcaaggcatttaccaatgccccaagcagaccgtgctgcccaatttgcgccgttcgcggcgttgactggttatcatgacttgattgaaaaacacgctgcaatctatgcccataaacactatccaaatgctcaggataaaagagctgtggcgacccagttgaaacagattgcagcgttaccaaaactaccattgctcaatgtcgattattttaacgataccgttggctattatcagacggcaaccagccagttggtgaagctcgattggcatcaagcccggatttatctaacggcaccagcaagtattgcgatggccaatatccgtagcgtttctatagcgaattaatcttaattaaggacggttccaatgactaaaattagtcgttagaaccgtccttttaagattaatgattattttatttcgcggtgatttgcattcgtccgtgctttttagaatgatatagattggcgtcgacgcgctgataaaaggccgttggtgattggtcatcagctgctaattctgataggccaatcgagatcgacagttggatttgatgatcattaactggtacagcgatatgattgatggccgcaaatagttgttcagcgaccgcaagtgcttcggttaaatcatagttggggaagataacgttaaattcctcgccaccggttcgatatagtgagatttgcggattattagcatgaaagacaatcgtagctacttgggcgacgtgctgaagaattttgtcgccagccaagtgaccataagtgtcgttgacttgtttgaagtggtcgatatcaaacatcagcatggtcaattgtgagccgtttttccgactgcttgtaacctgataattaatggctgttttgtaagctgcaaaattttcgattttggtcagagcgtcgtgattagcgaatgcgaccagattctgtttgaggtgtgcattggctgacaacatgctggcgtagatatagagcaaggaagcaaagacgagtaggtaggtccattcttgccaataagttgcccatgataagttgaacttaagcttcatgaaccaccagagaacggccccaaaaccagcacaagtgactaaataaagtgcgacttgtccctgtttcgtttggagtgggacgtgtttacgcaatcggccgagcgccgtaaagaagaggatcagtgtgacggcgtgcccccacgactcccagtaatacaaggagtgattgaagcccataaagataaagacaagcgggtacaagtagtaatagcggacacgtacattgagaaagtagccacaaaaagttagcccgatgagctggaaattcatgaaaatccaggcgtcgttctggcccacaacggcagtttgcatcccaaagacaaataacatcatgtagattaagccgtaccagtcggtaataagcgattggtcaacccgccaatgatgagtattgaagaagttgataatccaattttgtgagacccaaaaaagggtcagcacgcctaggatgaaaaaaacacttgtaataaatggagttatctcccaatgtgaccaagtcatacgcaaacacctttcaaatcgcaaaaactgcgttggttcgaattaaatgacgccggtataagtatatccctttaactgctaaatagcgactgtgattatggactttaattggctttttagccgttattatcagggaaaatcagcgggcctcgcgctagatacgccgaacggcaattaaagcagcgcaacaagcctgggttaaggcttaaaatgcccgagttggtgcggtgagcgtgggggcagcatcgttgacgaaggccggggagtcgtcgtaataatacccagttggtcgggacgtgctgtaataaaaccggtgtttaccagccaagcattaatcgttaccggaccgacaaatttaaaaccaacttgttgtaagtgctgtgcgatgcgatcgccagtaattgttgtgcgtgggagttcatcataatactggggctggataattaattgttgatggcccaattgttgccagagatagtctttaaaagactgtgtggtccgaatttgttgaatcaggcgggcgttgtgaatcacggcttcgattttacgacggtttcgtatgatggccgaattgctgaggagattggtgatttgttctgagcgatacgctgccaccacctcaatttgccaggcgtcaaatgctgcgctgaatgctgaccgtttattgaacacgacggcccagttgagaccagcggcaaaaccgccaagactcagaaactcaaataattgttcatcgcgctgaaccgggataccccattcgtgttcaaagtaataccggtagccggcatcgtacggatagtaacgattgaatagtggatcatcatcaaaccagttggtaatcattaaacaagcctcatttccaaatcaattagtagacactaactaaatacggtaaatgggtcggaacacacgtggataaaaaaacttttccaatcctcctgagaatggaaaagttaacttaaagcgtgttcaacgatgatctttgattacaaggttagttggcatgtggcgaacggttttcgtcgcgtggtcacgcttgatctgagctagaatggtcctcatactgactgtggcagtcagatcttttttaaaagtatgcacaccaaagctgtcataagtgacctggtcatttttgagtgtgaaccagtttggctggagttgcttggcatcggccttaatgtgtttatcagaccaaaccagatacttagtttgcccctggtcagtgtaaatttcgacctgccaacccaagctgaaatcactgacttcttgccaacgctgaatctttaagtgcttgatcgcgtaataaataatgcagctatattttaaagcaggctgtttagcaatggtcgtttcggtaatcggttgtggttgttggataacgcgtgatttgtgaaccgtggttgtggtggctcgcgaggtgcggtgtagggtgctgagaccaacaatggtaccgataataagaacagtgataatcggaatcagaatttttttcataagaaactcctaacgaataaaattgtaaaacgtaaatattactatttacaaaaatgacatttattgctattctttaaaacgtaatgattactatttaaaaagggagtggcaattgtgaaacgtttgtggctattactaggtggacttgttattggtgggggcttgttgacgggctgccagtctaagtcaacgactgctgaatcgcataaggtcaccattgttgcgacgacgaatttttatggtagtgtggcaaaagctgttggtggcaagcacgtcagcgtgacgtcaattatcaacaaaccgtccgttgatccccatgattttgagccaacaccaaccgtggctaagacggttggtcaggctgatctcgtcatcgctaatggcatcggctatgatggctggatgaacaaggtcgtgcactcgacgcaacgagccaaattgattcgggtcggcgaggacgtgatgcatcgcaaggaaggggctaacgagcatctctggtatgacagtgcaacgatgcccgccaccgcgaactatctcgctaatcagttagctaaaaagcaaccccagtatcgcacgtattttaaggccaacgcccgcaagtacatcgccacgcttaaaccgattcaacaggaacagaccaagttacgagcgaaggctaacaagttaaagaatcggcaagtgttagtcagtgagcccgtctttgattacgcattgaccagtttagggtttaaggttgctaatcaagactttgaaaatgcgattgagaagggcactgacccagcaccgcaagttatccacaagatgcagcaggcattaaagagtcggcaagtcgccttctttgtgaataacagccaagttagtgataaattagtgactaacatggtgtcattagccaagaagaatcaggtgccagtgttgaatgtgactgaaaccatgccagctaagttgacttatcaacagtggatgttggcacagtatcgccagctcaaccagttattgtccgattaagggacggacctgcaaggcgacgacgcccaattgcgcaacttggacgggggaatacaacgttagcatttcttgaaccatctgtgttaccggcgttcccggggcactgccgacttgaacggcggtgtactcgctcagtaaggattcaaaactagcgaaacgcgtgatgtcgatgagctgagtggtgagctgctggccagtcgtcagatcgatgaaatttacaatgtcaccgacttgtaaggcttggcgtttcgcatcgtttaaacggatttcaattgttttgagccccgattttattaacagccattgtggatgaatcaattgcatggtggtcattgaacgtcctcctaatcagtttagtcttaattatagtggataactaacgaaataggggcctaaataatggcaatgatgtgcctgaacaccggatattggtggtaggtagctggcgcctgtctataattaggttaacaatacaagggggatggcacaattggcaaaacgaacagcgattccagttagattacaaatcgttggcacgatgagcgcattaatcatcatgtatgcgtggggccgctcactaatcggccagccgttgcaattgggcaatcaacagtttacttggttagggttggtttacttgaccggcgcttttctgttcttgttagtagccccatggctgaccaatcgtttagcgttgacgccgtttgacttcatagcgatgacggatcatctggcaatggggtggttggggtatcttatcttaatcttagtcgttccggtatggtttcagccggccaattccgggcttacactcggcgtgctttccagtgtggttggtggaatttgtatggatgttccgcagaatgtgacctggggtatccgggtaccctggacgtacaactcgccagtgatctggaagaaagtcaactggctgaccggactattgttattaatcgccagttacggcatggttggcatcggctgggtatggcccacactgttcccaatctatcaagtgagtgccattgtgggaattatcgtgattgcgttgggctatgcgcaccatttggcccacttgacgtaagttgtgttggtgattattaacacggcaaattgatatacgcggatcataattaggggtcgcgagtggcacaagtcacgttaatcgtggttagttgaagcgttgttaacaatcgttgaacggcaaaaaaggctggaaaattccagccttttttagtgtctttttaatagagggcccaggcttgcatgccttgtgcgtggtacaagttaactgcggcgtcgatttgttgttgaacggaaccaccactaatatggatgttttggaataaaccgtatgcaccacttgcaccgttaacgacgtgtggttgccagttagattcacgattgatgatgtgattccaagttccggcgtcaacaccagtccgtgcttgcatttgaccgagcacgtaactttgtaggttatcacccgaatagctttcagttgctggggtagttgctggtgccgaagcaaccgtctcgttagtttgtgccggtgttgtttgagtcgtagttgtggcctgtgtttgagctggctgggttggtgtggtgaccggtgcctgctgaactggcgctgaagcgaccggtgtcgctggtgcttgactagtaaggtcctgggcgttcacccctggaatccgtaattgttggcctggtaaaattaaatggccgtgaatgttgttggctgtttcgattgattcgatcgtcgtcttatattcttgtgaaattgcccagacacagtcacccttcttaacggtgtaagttgcgtcggcgtgtgcagaaacagttccggccaatagtaggccaaccgttgcagcggatgttgttaagattgtggttaataattttttcaagttatactctcccatttttgtaagcaatcagcgtgtcgtacaattgttgatcaacaaaaattagtatagcggcgacttattactcgcatgtgtcgctaattttaagaagcgattgcgagattctgagaaaattatggggagcaaatattttactgaatagttgaagactatcgtgacgggacgtatcggtgacaatatatcggctactaatataaaaaatatgacagaaatagcaatataataattaagtgagactggcgatagtcttagccgggagtgatttactggctagcttcagcacatgagtcgctagtccgtgaccgatggcgtggttggttgataccactggagtggtggccgtacaagtgctatggaagttactacaacgccagcgttgcttgtttagctctagaattacgggccggtccatgggccctgcaatgtggacatgagtgagcttgtgtccgttagggtgcaacgtattgtatccacagctgggacagcgcctgagtgtgtaggtaagctctgcctggatgagcaaatactttttgcgacccgagccccaaccatgaaattcatcacgagtaccgaacacctacttttcactcgtttttttagccgctgattttgcggtggcttgggctttagttaattgagccttcgtcgcttgcgtttgggactgcgcatctttagtggcttgttgtgccgcagagacttgcccctttaaagccgtattatgttgactcaattgataatattgccggtttaatgatgccgtatccgattgggcctgccgtaattgttgttgattggtggttaaggcttgggccacttgttggtgatcgtgataggcccacaggccaccgccacccagtaccgccaagcccaccgcggttcctatccctaagctcactttctgtagcgtcttagactgtggctcgtgctcgaccgatttatcgggggctggttgttgtttagttgccaattgcgcggctaataattgcgctaattgactactcgccgctggcggttgaacctgcccggattgttgcttcagttgcgtcaattctgttgtttgcgtttgtaacagtttttgcaagtctgctttttcctgggtaactgtttgtttctcagctatcgtccgatctaacttgtgctccagctgttggacatcaactaagttgaatttggcgcgatcagcactggcttgggtttcaaccgcatttagatgcactttcgtcacttctaaggcatattcatctaactttttagccagattttgatataccgtcccggcaatattctgattattagccaccagttggccgacacgccggttatacgcagcacgagtctgttgttctaagtcgcgttttaaacgagctaattgttgttttaatgctgtttcatgagctttaagctgtttttcaaattcaacatttgctgtctgcaaagttttttctgctaagtctttctgcgtctcttttacttggtgttcatactcagcttgacgttgcgtcaccgcccgttcggcgtcggcctgaatttgttgcacatcagcgctacattgggccttcaaatcagctagtaccttggcttcggtacgcgctttatgctgagcagtctctgcttgaatctttttccgtaaattagcttcgtcggcgtgttcggcctgatagtcacgtaactgtttagcaattgcttggcgctgttgttcgctataacttactaaatcctgtgttgcgtcggcattcaaccgccgttctaacgtctgcaagtaagtattactgtgccgcttcttttgctcaacttgatacgccacatattgcggatcagcttccggcaccgcggataagtttttgacggtaaactgtgggactttgatttgaccaatccgggctggcttaggtatcaccactgccggtttatcggttgaactaccctcagcttgactggtttcttcagtggtcactgcttgacgattacccgcattagtcgcctggttcgttgttccccctgccgacgctgtcgccgccgcagactggttttcagtcgtggctcccgtctgactagctggtgccttttctgtggcactacttgctactggtgcttctgacgccggactagttgttggctgaaccacctcatctaatcccgtataacggacgcgaaagtcggccgcattggcttgagcttcactaggtactaaggccacaatctgttggtctgggttggcggcttgataggctgtcacaaactcattagcccaagtctgcttattgtcatagtcaaagtcggcaaattcagggctattaaaaatagtgttgatgacggtgccggtaaaatctcgatagtcccgatctaaagtaaactgattcactcggacataaggttcatacttaaaactccgcccagcttcctggcgttgtaacaccgtaattgtctcaaaaacaattggttgttcttcctcaatgacccgtgaccgtaattgttgaaacaactgacaagccacgttcaacgtcatcaatggtaactgctggataaggcctgaacgagccacccgttcttgttgtcccaattctttaatcagctcagcgacaacgggattgtgtcgtaatttttgactttcccctttactaaattccagcacaaatggctcttgtaacttcgcgcgttttttaaatagtgccatgttgataactcctttcaaacttgcgggttatgtatgaacgaggtagtaacgccttcgtcacccccgctactgccccgtttaaaaaagtctaagatctaactaccgaaggaaccttgtgaatacgtcttcgctaaggttgcgatcgctgaaatggcaaatagaccaatcactgaaataatgatccaaactaagtgactcttgatcttgtcacgcaggcgatcaccgccccaagccattagggcaaaacacccggccccaatcgcgatagcgccggcaaacccgacaatttgaaaagcattcgtgacctttttcataatgctttgtgtgttactaaccgcatctaaacttggtaatacctttaaatacccagtcactgccgccaatttgaaactagctaaccatgttgacatatgtcttcctcctttccataaccccgagtttacgtgctccaccatgtcatggcgtaaccctgcctttaacgggcctcaataatgaccttcaaatccccgaagcgatccttttgtccctgaaaaacaccgggccagcggccaacaacgcggactaaatagtgatatttagtcgcttgggtcgcatcttgttgtaataacacccgcgctagagcggctttaattttggcattcaacatatacgcaattggacgtgccccattggtcatatcgaagccgacggtcgctaggtactgggccacctcgggactaaaatcaacttttaactgccgttgcgctaacgtcgctttaaattctgttaaatacttggtcgcaatcgccagaccaatcttttcatcgagcatattgaaaataatcttgtgttcgatccggttcacaaattctggtcgaaattcattcttcaacgctttttctaccacggctttaaactgcaattgccgttgttcgccttgtcgtaagtggttgaattgttgctgatcattaacgactttggcggctaagttcgtcgtcataataatgatcgtgttcttaaacgaaaccggttgattatcactatcatgtaaaatgccatcttggagtacttgtaaaaataaatcttggacatcatgactgcccttttcaatttcatctaataagacaatggcaaaaggttgttgcttaaccgcttcagttaaagtacccccagcttcagcggtgcctaataagcggtgcaccgcatcttggccgttatattccgacatatcaaatcggattaaagcatctggcgacccaaacatggcctgggccagctgtttagccgtttctgttttacctgttcctggcatgcccaaaaatagaaacgaactaatgggcttagttggatcttggaaccccgcaaaatataacgttagggcatctaagactccttgaatcgcctgcggttggcccttgatattttgattgagcaagcgttgcacatcgttcagctgggcttgccgattcttcataatctggtgtaagggaatgtgcttgcgctgttcaatgaccttggctactgtcactggtgtcacagctttcaaagcgtgagccttcgcatacgcgcaactttcatctaataaatcaaacgctttatccggtaaaaagcgatcgggtaagtatcggacggcatagtccaccgccgttttggtcgcactcgcttcaatggttaagtggtggtacgtttcataactggcttttaaacccgctaaaatctgataactagctggcgcacttggttcagctaattgaatcacatcgaagcggcgggccagcgcaccatctttttctaaataatggtgatattctttcgtcgtggtggccccaattaacgtgatctcaccccgagccaaggctggtttcaacacgttactaacatcaagcgcattgtcaccatcactaccagtgcccacaatcgtatgaatttcatcaataaataccatcgcctgactagcttgcaattccgtcagtaaagctttaaaaaggcccatgaagttctgatcactttgttttaactgcgccagttccaacacataaatgggctgattttgtagctcggggggcacttgttgcgtcacaattcgcttagctaagccttcaattaaattagttttaccgacacctggtggcgcaacaactaacggattccgtttgtttttgcgacaaagtgtctcgaccaactgttcaatttcctgatcgcgaccaatggtttgatactgttcaggattagctgcgaccaccttagtcaaatcttgggtatacgccgccaacaaactcatgagtattgcccaaataaatcattaccggtattgtctgggccctcgttatcgcttttgtcactggcaattttttgaccactagcattaaacgtggtggtcttaggactagtggccgtctgatccggttgttgttcaaaatcagtggccgtaaatggttcggggtgcccctgacttggtaatgttgctggcacatttaactttggcgccgtttgatcaactttagcggtactagccaagtgatctgccaccgcactgccaaccgcttccggatcaaaatcttgtgtttcatcaactgactgtaagtgttcacctggtttggcttcctcgacttgatcagcactggccgctaattctgttccatggtcgggtgccgtttcagactgctgcttggctaatccatcggaccctactggtgtttttacgcctgcttcactagttagcgtcaacacctgtttggcttgcaaagcttgtaagacttggtcaactagcgcttgatcaaccggttttttaaaagtcaattcaaccggggtctctagaggaattaatttcccattcaagcgcaaatcttggccttccccccaggtaatccccgttagcttaatcgttgtgattggcatgcttataacccccgttctttcaattgcgataaccactgctcgacttgtttggtgctcgtaaagcctttggcttcaatgactaaccgtccagtttccttttgtaacgcgtcttcttgagctctaaacgccgcttgagcttttagaagacgggcttgttctgctttaatatcaacgatacgagaacgtcgattactcatgataaacactcccttaatttattaaataattgaaattgatcaaaagttcgcatatcaaaggtgactttggtatacggtttcgtcttgaccgtttgtaattgggcattccaatccttgaagtctgaccattccaccaagctttgacacggttggtgtgacttgaccaaccgcatgtgttggaacttttcaatcaaagcgcgccccgccacatcattgtccggtgctaagtgtaaataggctgggaacgccggttgggtgactagataatcattaatggtctgaatcttggcactggccccactcaaactcagtaattgactaccacttaactcctgagcgtacatttgccagtacgacagtaaatcaagcggtgattcaaagacgtacaagtgtttaaacggccccctaaaccggacattgaacccgtaatgcggtttggaaccagttttaatctgctttaacgagccatgtttgggataacgttgtcgattgatcacagtgccttgcacatcttggcccaccaaggcgccggccgcatcaaaccagttaaaaatcacattatggtagccatcactgcctaataggccttgccgcgcggcaaaggtaattagacgtggatcaaaatgccgatactgcgtcagataagccatgccagccgcatctaacggcgctaccggtcccaccgttgacttcgtgggatagtcagctttcacggcggctttctgatgaggattagttttggtaaaagctttgaggcgaaagtgcatttcacggtcactgacaccgtaataggccttgataaactgacttaaattaccagctaggccctgactgttccagataaagtaatttttgcgggtgtcaataattaatgaatcatgttcctgtgaacgtaaatatcgaccttcgtgcttaaagggcagcccagcatagctaacgtaatccgcaagttgtaacgccataaaaaatacctcctttaccggtaagaatacttactaccgacaaaagaggtcaaaacctgttttatataattattttgacttactatcacatgactttatttctgagaaagtgtaatggttaccttaataaattgactttcactaaagttatgcgcaacttgttttgcaaacctatacgcggaatcggtgcgactatcaaattcaaaatgcatcgcttttgctaaattcgttgtgatagaaacttcatctttagtgaaatcatcagcgtcataactccaaccgggccagttaataccttgattcgtcaaataccacccaggcataacttgcaataccgtcgtcttttcgttaccaatcaagccttgctcatactctgctgctgtcattttatttagcctcctcatcttacctatcaaaatcaaattttagcttaccggattctaacttcaatttggcactaaatgatttcttcgttttcttactcttaaaccctttgagctgggctgtctcaccagtcttgatcagttgtttaatggcacttattggcaattttttgccactccattgtttgggcaacgagaaatgacacccctgccgatagtttgaacacccataaaacttgccacgatctgaaatctcacccgttttacatattggacaaaccccaacagcggcctgcgcttgttgtttttgttccacctgttgttgggccgccaattgcgtctgtaagtccacattctgggcaaactgctcaggaacttctttaagcaatttttggattaacaacttaatctggcctaaaaagttttcgggcgtgcgttttttctcaccaatttcttttaaagctagttcccatttagccgtcatcgacggactcgttaacagtggttctaatgccaccgcttggcacagtgtcacaccagtgccactaacatgtaactcatttttattcgtaactaaatattgccgacgcttcagcgtttctaacacattggcacgcgtcgcttcggtgccaattccctcgacatcttttaacaccgccgcttcgtctgcgtccaaagtcttcccagccgttttcatggctgtaattaaggttccttcggtaaacggcttcggtggggtggtctgtttcgtcggggtggttaagacagcttgtactatttgaccaggcgtgaccacgggtagcgtgtctttcccctgctcaactgattttgcctttaagagacgttgccagccaggattgattgggactttgcccactgatttaaatagtgcttgtccgacccgcgttataatggtcgtttctgtatactcataaggcgccgcaaacatggctaacgtggtttttaacaccaagtcatagacctggcgttgtaagacaggtaatttagccaattgagttgaactaggcaccactttcgtcataataatcgcggggtgttccgtcactttttgaccattgacataacgtttttgcggcgttgtttgtggtaaagccattttttcaggcaataactcttggtactgatccaggttcgccgccaaatagtcaaactcttgctgcgtaagatactcactatcagtgcgcggataagttaaccactttgcttcatataaggcctgcaccgccgctagggtttcactcgcactcgcatgaaaccgttggttaaccgcactttgtagactagatagtgaaaacagccgtggactaggggtctttttgacgatgttttggacatctttaattaaagctgtctgtgggccccgctgaacgcttttagcctgcatgaatatcgttaaccctttttcgtctttaaagcgctgataggggtctaattttgcctcgaatttttgctgattggctaaaattttggcatttagttccaagtagggttccgactcaaagtttttgatcagttgatctctttgatagaccatatagagcgttggcgtttggacgcggccaatggagtacacccccgacaacccatgttgacgtaataacaaggtgtacaacggactagcattcataccaacgagccaatcactgatttgtctggtctgggcttcttggtaattcggataaaattgccacccatctttcaaatcgcgaaagcccgcgataatcgcctctttttccaaactgttgatccacaaccgttgcatcattttgtgctcgacatcaattttagcttgtttcatgattgaccaagcgatattttcaccctcacgaccattatcaccagccacaattatcgtatcagcctgatttaataacgtcttgaccacttgaaactgcttttgcttgtccgcaataacctcgaattgatagttggctggaaatatcggtaagttggccaaagcccaattgcgatacttcgcatcatttttttctggcgggacgagttcgaccaaatgaccgagtgcgtgtgtcactagcgtgtcattgggtaatactggatcactaacctcatagtaacccgcctttttctgactcttttggaaggccgccacatacgcccgggcctgactgggcttttctgctaaaattaccgtcgtcataatttgaactcctaacatcaaatttagttccagcttaccagcctggcgaccttagcgttaaactcaccttcccaaaagattttttatgagtaatgatgcttgcattacagcacgcactgtactaaagtaacagtcgtattaatattacttctccaaggtaatcctttttgtacaaagattagtcctatgtactatatattctactccgaccactcataacccccattatgagtggctttttgttcttaaaactaccttttagctactgaaatatttattgcgagtaaccggttgtatattgattgctaaattttccaatatacgttattttaggagtgccaaatcttctcctgttttggcattgcggtatataacctaatcaattttttcacacaatttccgctgaccgttcgcaatcctcattacgagcggttttttaatttttgtggtagaatgaatcacagaaaaaggaagtcttgattgcacaagacttcccgcgtagagccgtataagacggtgacaatttaactgattaaaaaataaccgctagctcgtcacagctaaggcggttatttttttgctgacttttaatcagctcaacaattaatgcaattaaggctacgataaaggtgccgaaagccagcattaattgtaaagcgtccgaaacggacacttgggctactcctttcctggaatttgggttggcttattaggtttacaccataagcaccatctccaatactggaaatagccaccgccttaacttctctactagcatagtataacataatgcacgctgtaactaccgatactacggtgttcacagcgtgcattttagctaatttacccattgtttaattgcttgttcataatgtctatctggatttactcgtggtctacgggacggctagaatttaaataacaccctagtctagcccagccctaagcaaccatcgctatcgcttccaagtgctcactcaaaaatcacgataagtgttgttatacagacatttgtagcgacttttgtttttctaatcgattatttcttttgcaatttccaataatgattcatctctaaaattggtcccatatttttggattgccgcaacaagatcattttctgttatcggtattgttttcctaaatatctcaacatcaacatgttcctgatttttaccgaaaaccaaaaaatcaatactttcttgcatgccatcattaataatttcctgatggtgattgtaaaaaataaaactcagattaataaattcaccgggcttgttcctaatttgaacatagttatcagttagcggtgaagcttccaaaacaacctgctcacaattagtatgaatggcttgatataggccactctctcgtttaataaactggccaaacaaaggaattgctggtgaactttcccctaatatccatggtaaattatttaaagttgcttgccggtaaagccagccttcatcaagcatgtagttttcgagcatttttctcgctaggttccgactaattcccaaatcagttttctgtctcattattttaatgataatatcaaattctgatttcatcgtggttagcattttattggctaacgagctacccgccggtcgcttgccactagattttttccaactagggttggaaaaggggcaatcttgataatcaatctctgaatacattgctaaattagcaatactgcccttattatggcgaccgtatggttttctaccagcctcactagtattcttttgtaggccaacaatttgaattggattatcacatttcggacagacggcgtaatttgagattcgattgcgttctttttgcacgtatggcgtctttttcaatgtctgctcttcaaaattttttctcgttatctgatacgccggggcaacccccactttcaatttgaattgatccatttcaacgcctcatttcagctcattacattgcgtatgtctatccaccactgatccgataatggcggaacatagccttccttttcagcgatccataaacagtttattactaccgacaatggtaacgaaaactcatgctgaccagcttgcatcttaaataataaggcttcacaacaatcttcaccgccagcatggtcttcaacctgccatttaccagctttaattttcggtcgtgcttgatttattttttcttcattcattttataacctcattttatcatttgttttagtcattgcccacgtttaacagccacttccaaccccaccctggaactaaatcaaactcaagccattatataaactatgcaccacccaattgagacgcaaatcgtgttgccgctggtataagcaagctaagatcaagccagctccaaaatacaatagccaacttagactgagccgtatttcatggacgctcgcaaaagcgccggcactcactagagcctgccatctttgatgttgtcccaaaaaccagcgaaaaaataagcctcgaaacactaattcctccatcagcggcgcaatcatgaccagttggacaaccaaccagcctttccgccatcctcgcaagctgagccacccagcaatagcttgttgattagtcgttgcgtcttggcccaacccgtgcattattgtcatcaccatgacgctcattatcatgaggccacctaaggataaaccacccttaaacaatagggcgcgccaatcgtgaaccggccgcaaccagttataccgacaaacatagctcagccctgacgctaatccaactagaactaacgtcccactgccaatcagaaaaatagctgtccctaaggattgcgctagtaacccggctaagtacacgccggtcgcccattgctcaagcagaattaaccctaaccagccccctactttgaccactaactgcatctcaccgcccccgttcttgttgggcttgttcaatcgcttgttgctggttaaacaacgcatttttggcctttaaatcttgataatgggtctgttcggctcgctgcaattgctgtttaacctgttgctgttcttgctttaatatttggtgactggcctgttgctgtctgcgttgaaattgttttaagtgcagcggcttccagtggttgacagccgccttcacgggcccccacccagcctttgttggcgcttttttgtcccgcttgattttagcgctgagctgttcgattttctggtaccgctgctgcaccaccgctggtggcaaagccgcttgataaccggctagtgaggctttcaaccgcaacaattcctgttgttgtttagtgctggcttgaacctgcgcgcgcatctggtgtggcttcgctaatttaacaccgagttcctcacttagagcctgttgaagctcaggtcgcaatttagaccatgttaccccactgaccacgctacccccgttaaactcactttctgcggtcaagcgtgcttgcattttagcgacctgtagagctgttaatttatcaatcggtacattgacaacatcagtaaagtacgccgttaaatcttgtaactgttgccgtgccgtggggctttgttcccatggagcttgtagcttcaatttagcgagcgttaatcgttgctgataccggtcatttaaaaaggtacgggcctcacgttccgccgcattaaatggtgtggattcctggctcagtttcgttaacactcgctgggcttgttgcaccttggcctgactggctcgagcattttgctgacgcaaggcaatgcgccgttgccgcaattccttggtcttggccggtgttccctgtaaccgattcgcttgccgtaaagcattgatccgttgccggttagcttcaatatcggccgcagtaaagttcttggctagcccgacaattgtcagttctttctcattgtctggtagctcgcgacaagctttgaagagtgcattggtaagtcgttctcgcagttcggcttctttatgtgccagcgtccgcccagtcgtccgttgaccaaaggctgctgcattgtactgatctagtgcctgcaccgtttgcttaaaggcttggtattcgggattgccttgcaaatattgattgaccaggtcactcgcgagctgtttgggtttcgccatatcacgcgcattacttcgagaccgccatcgttttttatcggctggcagacttgcaaagagggcctgcagctgttgctcaccaacagcctgactcagttgctgtcgcagattagcccgttgaacacccagtcgcttttctaaggttaacttttgttcccgttcgcggggccgatcaaaggcgatcagcgcttgaaagacctgactcttgattttgcgaatggacggctgtgtgaattttcgccgtgcttctttggcaacgcgtttaccgtcccgataaccaattttatccggtcgcgggcttaactctgaaatacctaagtgcacatgaatgtgattcgtattgaattgaatatcgccccaccaaaaacccttttcagctaagccgttagcctttaagagcggccccatactgtgacgaactgccgctttgatcttttgttgatcacaggcttcagtctcagggtcatacaaatgattatcaatcagatattgcgttgaaaacgagagaaccccggcccataacacccctttattcgcctgcgctgtgtctaattttttccgtaattgatccgtctcggccaccgttaagtgatccgttcgttgatcaaaggttggcgttagttgttgctgattgggcttggcaacctcgtcaccttgatttaactcagtcgccgtattgcgcgccgtatagtcgataaatttttgataaggcaagcgcgttgccactccctctaccgcctcaactggttcctcatcagcgcgctgactagtcggtgctaattcagctaagttggctttttcaagttgatctaatcgctgttgtaccaaattaacatcgttacttaaatccgttgcattatcacgttccgtgtatttcgcatacccactgtaactcattttattggctaccgttgcggcggtaaaatactgcaaactaaagaccactgctggttgctggtgttcaattggttttgacataatgctgtgcataccagtccttccactgtttaaattcagtccgattaatctttaaataattgacatttacttttaataacgcacaaatttccttctcagtaaactcaaagtaagccaatcgcgcagcttgttttaaaactgtcgcgcgctcattagccaggatttgttcgttagccgcaaaatcagtaaacggcactggtcgaatcttaaccaagacttgatatagtgctctttcttgcataattcgcggccaatcttctggactaacttgttgccgatacgtggcattatcgatgatgaatttttcactatcattatcataggcaccaatttccaccgcccacttatggtcagccgtatcgtaactagataattgcgctaacacgttcataaactggtcagacaaatgccaattttttttgctggtggttttgaattgatcaactaacatgttcgtccctcccacttttagtgttgccgtaattgattggcttgaatatccgcttcaatcatctgttggacttgttgaatggcaatgttgttatcggagccgggggtataaattgacccgccctcattcaccgcccccgctgtgcggttataaattgacagtaacaaatatttgatttcggcttcattttgccgacttagtcgcagttgcttatcaattctattttgttccggtgacgccgatgctagttttaataactcggcttcacggccataaaatgattttttcgctaagttagtatagaggaataactgaataaactcactaataataaagttgtacattttattttctgttcggacgagtcgggctaattcctcgttctcttcaaagtaagctttgagttctgaaagccgctgttgattataagcgtctagccgtaaattaattttacgcccccgttgtttgttactaccggcaacctggtcattgtaatctagtggattttcgttagccatttcaataatctcccttcaccatggcggtcaataaattcttaatctcggttaattcattggtattcaaattagttacttcgaccacccgattcatcagggccgtttgttcaattaaatggttcgtaatatttccatcaatgagaaaatctaaattatcctgcgccaccacttcatcaataattgcgcgcataaagtcagaaagattatcgtaacccgctaactcacccaatcgtttcaattttgttttgtcagcttgcaaaacattggtcactttaataacagtcttatccattctaagaacctcccatagttccaaaagtctaaagttcaaattcaaattacacctgctaacacgacgaaatctgagatttctgtttttagcggtttagagtatcaagacgaaatttttaatttctgtggtactagctaaagagcataagagaaacaaggccctgccgattaaaaatcgccagggtcccccgcagtgcgggggtttctatagggccctgcggttgctcgttttttgccgttttggccaccaaatggccaccacttgaccaccaaatgaccaccatttaaccaccaaatgaccaccaaccagaacttagtttttatgcgtaatttgcgtacttttagtgactttagccagtttaaacgtgccattttgaatcgcagtttgcttctttttaagtaacgcttgggctgcttttaaactgttaattttattttttgaagctgtaatgacttgttgattttgttcaatatcacccgtcaaagtttcaatatcactgtctgtttgtgactgttgcgaggcaatttcatacttgcgattctcgcgtttcgttgcgattttatcattgtccgtggcaatcgcttgtttcgccatttttatctttgtaccttggtgtttaatactgcgctggcgactattgatttcatcatcaatagcctcgatagcaaacttttgcggactcaaattagaaacttttgcgcgtttaatcttggcttggttagtaataataaagtcggcctgcggtcgcgtcgaagtgctctgatctggttgtggggtcgcattgactagccgcaaacggattgcttgaaagtcatttttgagatggtcaaccatcacaacatatttattttctgtcactggaatgacgaccatttttaagtgttcgggagtcactgtggctaacttgaactgtaagtactgggccaatatttcggtcgtaggatcagtggcgggttgcacttcaaaggtcgcgatcaggcgttgttggcttgggctataatcccgctgaacgagtttaacaccttgggcattactaccaccgctaaagctctgataactatttaaaggggtgtcatcatgcttggtcgcctgccgatttaacagaccataattaatgatgagtccgccagttaaaagtaagtaaatcccgattaccaagtaccgtcgtagccggctatgctctcttaaatattgccacccacgcttcactttattcatcaatactgtctcctttaagggtcacttgccgctgagtaaatgtttgattgtcgttaaattggtcccactataacgcgtcacttgaccatgctgataacgtattaaagttggcgttgtcgtaattttaaattgctttaagtaccgccgattttgtgcggtttgcgtattaacattgaccaattgtcgggctccactgaaatagtttttagtctcagcagtcagcacttgtggcgctattttgctacaatcgcgacaacccggttggtaaaatattagtacggcttgggtatttttttgcatacgatgtcggacaacttggtcgaccgtattggtctggctaggtcgaattaaccgttccggttgccaataaaaccaacttacaatccccaccattagtagcaataaactaactgaaaggcccttcaatttccaagacttatccgtcataattagcccccattaattgatcaattttaaacttggcgactaattctcggagcgctttagacggccattctattcggctaacgatcgttggggcgttttctagtaattgtttagcaggaaccggattttgactgacaataccaacttgtaccagatcattgtccggccagctgactaacaccacatcatttggtttaattgatcccgagtgattaaggtcgtcatcagcttgtacttcaatgggatacgctaatcgatctagcttgatcagctgaaccatcatcctagttatcattacccctcacactccaatctaacaattcgtaatgggtgggttaagacgcgcaaactttggcgttgaccacctaaataatgaccgcggttattatccgtatcaaccaaactaggaaagttagccaataaccattgttgcgctaacccgcgcgttgcgaacacctttccataaactaaactgcccgccgtggtatccaaaatgccatactgactcattttatagcaccccccgtttgacaaattgacagtccttagctagggcccaatcattgcggcctttagcattatgcaccacattaatggtgatgccattttcaatatgttgttcaattaattgaccgacctgcggcgctgttgttactttaatttcaccattagtcgtccgcactttgtaagtcacccaatcacctaagcgcatatttttagtcattcctattgttcaccccacggattttgttcgagtcccgcggccaaccgttgcacattacgcgccatcttatctttcaaccgcagcaaagccataattgcattatcatacgagtcaatcttagtaaagtcactacgttctaccacttcacttaaccggtcagccgcttcaatagcagcctgaaccagttgattaaattggcgatttaattcattgttttccatcaataaagtctgttggtgtttcaattgatcaatcttttcagtcatgcgctgataatcatcgctcgtggcggcgtattgatcacgctcagctctaagtgcttcaagttcgcgatcaccttcggcattgacttcttctaacaatttatttttagttgctaaaattttagtttgttgttttaagtcttcataatcatcaggcaccgttggtacgggtatttcaacttcacgaatgccttcagcttttacccgttgtaatcgagcttcatacttatcttttaaagccacttgtgccgctttgtgttcatcatctttagcttttagctgtttttttagttctcgcagttcacgaactgtcatttcatcaggagtcttttcttcacctgactctaagcgatgtagcttttcccgttcttcttcgggtaatgtcgcaatttcatagagtgcttcaacacctaaatcggacgacgtcgtccgatttaaaagttcaggtgtattagcaattgatataaattttcttgccatacgatcgttcatatggatttttgctaaccattttccaaatcccccatgtaccaaatgttgttctttgacccactttaaccgtcggcctatctcaaaaatggactggcctgcaactgattggtaactcttaatttccgtcgtaatttgtgttaagtctgttgatagcaactggtcactaggtgtctccaccacttgttgagtaatatctttacgttccatttacttagccctccttaattttaaaagctcatgtgaaggcaacaaaaaagggaacaactggtttcccagttgttcccttatgtatctacttgaccaacagtcggcttaatttaacacgcaatcaacaaaataaaacttctaagacaattcccagtctgacagggttttgccgccatgacgtcaaattatctaaagaaaatcggccctaagtgccaattttctgctgattttatgctaaacttaattccgttactgctgaaacttagtagtaacataagagagcaagtaggaaacatagtgtatttatgtttcttacgtcgaatcatgctaaagcttggactggtaatccaagttcagtgattccgaagctctcttttttgatgccctcgcatcaacctgtattcaactatctagtgttaaatacaggtttagcatagcgcatacctccatcgatgtcaaagtacaaatcacatcactaaacgagaacacatgttcttgtttacgatttaaatttagcactttcttaataagtcgtcaatcgtaatactcactaattattaattggctgcctttttaactgtgattccaggctctgtggtagaatcgtaattcaattgtctatttgaatttggaactcgctgaatcaactgatttttcagtttattagttgtgcccgtcacttcttttagagttttataactaataaattttcggccaccagcttgttttatgtcactagttttaatcaattcatatttcacgtttccgttctcataagccggactggaaaaacgcataacttcgctggtaattttattgtctgggttttcagttaattgataagaaactttgactggcttaggcaaaaatttttcaaccatttcacttttagtatatttaggtttgacataggttgtcgtattcttgttttcataacgagaatcatactcatcttctaaagactttctattccattgtttggccagtcgaataacttctttatcagtatgccctcttagatcttttactttttttacgtcaccatagccaatactagccgcaagcccatactccgtaagtttattatttttcaagacaagaattgcattaatatccttatctcctgatattttttcataatctgaaatttcataccaaatctgcgttccttgcttggcttgatgataaattgccacgcttggtttactagtcgttgttttgccgcaaccaaccagtcccactgctaaccccgctaccagtaaccccattaactgctgttttttcatttcattcgcaccccttttgttttagctattttcctttttacttttttctgccgctaacgctgctagctcagccgtgacccgatcttgcaactcttctaaatcttgtttacgggttgtcgtgtcaattgtggctaccgcagctgctaattttcccactggattggcaaatcgcatcgccatgttacgcgcccgcttataggcagtcgcttctgggtgccgcttctcataagctcgattagccctaatttgtgcttctgaagccatactatgacctgctttctttttatttttgtatacctcaattatataacactgtgttatataatacaagactttttataaaaaagaggcgcctaattcatcattaggacgccatcttgttaatgccaataatatttttcattcacttgcagataggcccaaaaagcttggcctaaaatcgaagacatgcttcttttctctaaaattgcttgaatcttaatccgttccagaattttttcatcaacataagcggtcactttcactcgtttgcccatttcttcactcctttcaccggttaatcggttttgctgatgaggctgtcaatcgcggtaacctgttggttttggctgtcgtaggacacttcgtagacactcgtccctttattccagattttagcactcgcatatttgctctgatacttggccaccactaacgcctttaattgcgagccactaacagcttggcggtaaacccgtaattgcgtgagttttgaagtcacttggctaccatcaccatacaattggctcttaccgccaaaatactgttggtttaacttgggcgataaccagcgtttaactttggcttgccgttgttggtaagtatcttgattataattatagaggccattgaataccgtcgtaatattagcggtcattgtcgcattactcgtttgctcagccttgttatcggcactattgttttgaacttgtcgctgagccttaacggccgcctcctgagcttgctttgccgcagtcaccgtgccttttaatttagcattcgtcttcaacaacgtggccttttgacgcttgatctgactaatctttatatttttcacttggacttgatggtactcatgaccaccccaaattaatgcgcccgccgcaaccaatcccaaaaatacgatgataactgttttgcgttccatgttctgactcctttacttcgctttgatggcccgggcaaacgtcgtttcgcccgataataagctactaaacgctgtcccaaactgcgcaatgttaatgcttttaccagtgcccccagattcaataatccgggtctgattgccatgccagtcttccgttagaatggccgtatggccattattaccactaccttcaccttggttcacaatgacaatatcgcccgctttcgcttcacttttatcaatggcttttaaataatgatggggcccggtggcatcgctggccatcgtgccagtaaaccagcccatattagcgggcactttataaccggctttatttaacacgagccacacaaagcctgaacagtcggtcccaccggatttattaggattctttaagtctttccccaaatctgaactcgggtgcgtctggacataatagaaataccctaaccaacccttggctgttttgagaatatcaccatcattctcactagtcgcgtcacaactactcccagctgtgtcatcactagcggtcgctaacccatcactcgtgcccggatcagtatcacctaatttggccagccaatgatccgctaatgggtaacgaccgggttgtcctgacggccctttctctaagaaccattgttccgggttattgcgcataccttcatattccatcaaccagtcatacgctgcttgatgcgcgctggtttctttgaaaatatgtttagcaccttgatagccatgagccatctcgtagaccataaagttcaattgggcatctaaggagttccattttttattatttttagtcgcaaagctcatgaggttatcgtaacggttgctcatccactgggcgaggcccgtcgcccccgaaccgcccgtattcttaacgctcggatttaattgtgattcaaactgccaaacacccaggattcccgcggcggcttgtggggttgctttaacatctttgttagtacgtaagaactgataaatcgtcttcgcattcttattcatgtcagcgctggtcaccacgttactgctagtatcagtggtcaccgtacaatcattattatcatcgctactggcaataaacataatgagtaacaacaaaacactgatcaccaagagtggtacgcctaaacctaggccggcaatcatcagtttctttttcatttatcctagccaccacctcactgccaaaatcaccaccaccaatgcaaaaattaacccaatgggtaaaatcaacttatcctgaatttgcagtggattttgggtttgactcaaccgtttcagttccgtaatgcgcgtccgccgggcctgttgccgtaacgccttacgttgcgccctagtttgcttatttggttttggttgccgtttcatactagcccaccccgccatcataacgatctagcatggctggtgaggcctgcacggtaaagacatagttgccattgccttcaatgtgcataaagcattcatgctcacctaactgagccacggtggccagttcttccggcgtaatggccttgccaaaagcttgttgtaaccggggtagatcatcagcggtcaaccgaaagaaaattggataagtaaacaacccaaacatttttttcatggcggtgtcatatttttgataccgctcacttggcacaatactcttgctgtcactcaacatttccttgatggtcggcatcaccaggttcaagccacagaaattcttacgcatttcttccatcaggttcgtcaaccacgccacgccttccgcaaactcgggcttggcgtaattttgaaattcatcaatgttcaaccagtagtaaggcacatcttctagggcgacttcgtgattgttatacagagtacgatactttttcccgttattaataatgtccgcggataataagcttaatgctgagtacacctgcgcattaaacgttgcttccccgttatttttgaggccagaacaatcaaagaccaccgctttaatcttggaaaaatccggtatcgtggttagcccattgaagatgtcaccatctttcgtcatcatattttcaaacgtattagcgatgcgattaatcgacgtaatctcaacatctggccgccgcgtgatttgatagttgtcttgcacttgccgtaaatagaccacaaactcccctaaagtcgggtattgatcatggggtaacccaattgcgtacaacttatcacggttttccgatgggttggccacccacatcttttgcatgatataaaattccgtggtgagattttgcagtcgaattcgatcatcattcgttaaatccaaattttgtaagcaagccatactgctaatcttttcgatatggtggttaaatgacccaatttcatcaatcgcttggccgtctttcgtcgtggccgttggaaagatttcaaacgggttaatccgattctcactcccgtctagcgagatcacgagtcccccttgggagcgacactgcttggcatactcgttggcaacatcaaaagtccgagtaaagcccccgcgggcaaaggcgatatcattcaacattttagctaacacagacttaccagaaccggggcgcccggcttccataaaaaacgaagttaagcggttttggcccacataaaagggatcaagcatgattttgccttgggtcttcgaacaacccaagtacaccccgtggggatcatcaagttcgatatgattgaacggaaatccatgaccaatgacactcgcggctactggcgtaccctgccggtgattgtccaataagctttgcttctcggcgggcacatataagcttctaaactccgcttcctgttcgccatagaaaacccgcaccccaaagtcatcaggcatatcttcggtaatcttagtcaaccgttgatgcaactgggattcattatcagcatacacaaagacgcgaatactgagcttcttcatcttctccgcgtgcagcagatcccgtaacaatgccgcctgcttttggttggcttcgtcggcttccatgcgcgcaatcggcttagcgtttaaatctcgagcctgtgagttagtttcagcgactgaattttgtaacgccttacggattttacgttgatcttccgtgcctaaactaatggcggtgacggtgaaatcatacttcataaacttgcgtagccaaaaataggctaagcgttccttcgggaacttaaaaacgtgcagacaggcgacacaactacccccaaataccaaatgactatccaaggtcgtatcaacgttgccttgtggctgggtatgtgctaatagcgctaaatcatatccagccgcttgtaattgtttaatcttacgttttgttaacatgtccgcattcctcccttaaattttcttgtcattcatattattaaggctgtataaaaacttgatttttcgatctaggcttaacgcttcaaatcgtaaataatgtccttggcggtgcgttaaatcgtgtaaccgttcattcaattcagctggagttgccccaaagattaaggctaagtattcttgactctttaacgttttctcgaccgctgtcgcgatttgtaagctctcattgatataacgtaagcgggtggtcaacatttgccgctgttgcgcatcgtgacaattaaccaaggcttgttccactttcagataatcatgatttaaactcaattgttgttgcgccgtcgtggccggaaactgggtcgcaataaaactccagtctggatcataacgttgtaaaaattcagtaaactcttgcgttggctggcctaacatattatcaggaagcgaagttaagcccacccccggaattcggcaaatttcggcatagccccagtcatgcgacaggattaaataatggtgatcatcattggtaaagcctttgtatcccagcaattgttcgacactacgccactttttgaattgcctgctgggatcaacttggcttttttcaacttgtcgaacttgtcctaacggggtaactgctttaactgcgccattgcttattttgtgcatcttgttttaaccctccaatcgttaataacgcactaagtgaatcaaattcgtaatacgaataactgtggtaatagtgtcctcgcatcaaaagatcattaatcactaattgataattttttttgccgggattatggtacggtgtgacgactagccaaatggcaaaagctagattaattccctggaaaagccagttaatgccagctcgactgtctggaaacaccaaattagcaataatcattgccaccccacaccagataagtaccaggacaatgtcagccacataaaaaaggaaaaccttcatacgtgccttaacgtcaggggtcacccccacatttggcatattattttgtcccatcaatctcgctcctttcttgaatagtcctagcttacctagtgcattttccaagggagaacaactactctctgacggccaacttacgagaacaaaaaagaagtgcgaactaacacctaataccacagcgttaattcgcacttcctttatgtatttaagagtaaaaaaagcgcccctggtaagggacgccgtgattaagaccgtcagcacaaatgctaactagccttaatcgaatacaggttgattttgcgaggtagttactaccaagcattaatagccggtaagctattaacaaaactatcatacctacttttatactcttgcgcaaccataactaactcaatagatcgaatcatcaatcttaatatctggcagattaaccatactctgaccatcaccaccatgctcgcgagcgacagccgttaacacggtaccagccttagttaaggtcttacctgctgaccgcttggattcaccggccactgacggtcgattgcctggtgctgacttaacctcatgtgaactcagtggttgtgtggtagtacgatcaccatctggttgcgacattggctcgctagcaccattttcacgggttaagccttctggacgatccgctgaactgacctcggcaccaactgtcggtgcaccctgatcaacttgttgatcagcactgctagaaatagtcccccctgtagttgggtttgatatgttgccttccggactagcctcagtctctttagcagttgccataccagtctcatcggttggtgcttcgtcagtagtcggatctggtacgctaccttttacattggtgccagtttctttaactggcccttgattggggcctttgcccgtagtaacaccagctgtcggatctggtaaagtcccctccggactagcctcagtctctttagcagttgccataccagcctcatcggttggtacttcgtcggtagttggatcaggtacgctaccattagcattggtgctattttctttagctggcccttgattggagcctttgtccgtagtaacaccagctgtcggatctggtaaagtcccctccggactagcctcagtctctttagcagttgccgtaccagcttcatcggttggtacttcatcaatagttggatctggcaaggtaccactagcattggtgtcaatttctttatccgtgccttgatcagggtctttgtccgtggtcacaccagcggtcgggtcgggcaaaggctcactttgatcattatctggttcctgatcagccttgacggttggatcaggcatcggtggcacctcattaccagcaccatcgcccattgaagtcttggtgccatcagatgtggcttgagaagatggatcggccattgatgatttatcagccgctgcgctcatcgccgcttctgccgttggttgctgattactgtttggctgatcactctgatcggctcgatccattgttggcttaccagtggtttgattagtctgttgctggtccttggctggcgtcgccttagttggatcaggcagagcagccgctttacccgttaaaccatcaacccttttttgataagacccttgcatgccttcacgggccataccaattcctttagccccagccttaatgcctttaccagccacatttagacctaagccgagccccatcaaagcacctaatgcggtgccattcttagactgcggtacacccgtccaacgttcaatcatactaaccccagtcataaacgccacaaaacaagctagatacataattactaagaaaaagccaataggcaaggctgaattgggatattgtttcaagaaggccacgcccggattcttagctgatcccagataatctaaggcgattaaaaagagccgtaacccaatcatttcagcaaatattgaaataaaagagccttgaattgcctgcatgacttcttttaaccgttgattggtgcgcaaatcttgaaagcccatcagcggtgccgaggcattgagcatcagaatttcaaaccatgacttacccacccgaaaagcaattatcccgaacatacaagcaagcaataaaagttgtaagtccgcaatgacgaaatggccagtataacgcggataaaccgaatcaaacgccttcgttaactgactttgtttgcttggcaaggtggcatcttcaaccgtatattggttcatttccgcacccattttaacgcggtgcttaaaaacattatccacacccttaggaatggcattggtctttaaattgtcggaggcgaccacttccgacagatctaaatagccaatcgtactttgatcaatcccattgtacttggccatctgtccatctaactttgatggatcaaccttaaaaccccttttagccaaagctactgaatcgacaatattattctgtacaggttgcacggcaatactggtcacattactaccgttactgccaacaatctcttgggcaccagccatgacgaattgactaaagagattcgtcccaaaaggtaacatcactaacacggcaatcacgactaccaagttcgtaaacacttcatgcaacttagttttcgccctaaaaatgttctcaactaacaaataacctaacccaatcgttagtagtgcaaaccctaaccacacaatcgttttataaagtgcgcccatctcaccaacattgaagttggcaaaaaaaccaaataattttaggacggccataaacacactttctaaagcctgcgccgtatgatatagccctaacaaaatccagccattcaccgtgccaataattttctgcaccgccaatatgtccgtatgcaacacattgtgccagcgcaaatagaaatcaacaactccatccccttttgcgcctaaagaactccctccccaagtaaatattttatcacccagctgattatttctaagtaacgcatctggtacttgataatcagccactaacaacattaaccagttcataaaaattttcataccttaactcctctcactttcaatttacagccagcttaatcactgcccatcaaaagcgaggactcctgcacatagcttctgttctaaattttccggcttaaaccccgcctcggtcaagacgctccaatccaaattgaatgtctgtcgttaataactaacgctaaacggtttggaggctacgggacggctaatagctgaaaaatacactagtctagcaccaaccccaatcccaataactttgacacccccaaccaaagcccacttgtacagaactatagatacgtaatggcattttagaacacaaaattttatcccgtatctactaatctcagttgttcaaattcagtagggttttgatcactggttaaactgaatcgttgtaatgccagtaattgttcagttggactcaagaagcgcgctaccattagccaatagtttaaccgttgggcttgtttgagtgccatcgcatgttgcaataggctgctccgggtcgcaaacatggttgcttgacgaccatgtcctttttcacgataaactaatccctggtcaatcaatttattcagggctttggttagactacctaagcaaatctttaattctttagaaatgtgacgtaaagaggttttggtaaaccaattattgtcctgggaaattctttggttaaagtaagccatgagatccgcttgccattcctgtacatgactattaacgcgttctgtgcgcggcttcgcatacttataccaggtcgtttgcgaacgctgcaaataaacccgcctgtcagcatcgggaacccaagtttctagtaacgcattcacatattcacggctggccgcatggaactgacctgaataagcatcattaattactttttgaacgtgctgtgtcgccagcgggtggttaagattgctgttaaattcgtccaaaatatcaaaacactgggcttgcgagacatttgaggaatagcaagctaaggctagtgtgaagattgtattatgccgaccatagcccacgttttgatcaatgtccgtttggttaattaaggcttgaaaccacggttggtcaatctggcgactagcccgccgagcataaaaagaccgttgagtattttggggcttaatttggtgctggtcattcgcaaaattaatgctccaagtcattaaagcttggaagtcaaccgtcattttaggctcaaagtattcaatattgtctggccgtgggactctgaaaataccaaagctgttgcaagtcacatcgaccgctggtaatttttgcgcgtagtattgctttaacgacttagcaatggctttagcagccctgacggctggcaattttccattagcatgacgacgaacgaacactggctcatcaaagacatagtaaatatgatagcccttctgggtcgccaaaattaaggttggcataaactggacgtccaacatcgccgtgtcccaaacctcagcaaactttgcttggcgttcctcagcatcacggtagtcaacgtcaaccactaacgtgttgatctgacttaaattttgttccttagcgtctttcacataatgcttagccacatcagtatacgtgaggtaattaaaaacattcggcgtccaatgcgtgctggtcgcatagttatcatggacggcttctttggaggtataaatcgtcccccagcttttcgccatttgggctttactgcgatacatagcaatcgcaccgtgcttattctgcttccctggcaccgacttttctaactttaaaacgttactatgccgggccttatgttcccgtaatccttgatgcaaaatcaaatcaatcgcttgttgtgctatttccatcgctgacatactgctcaccccctactaaaaaagaacgccgtagcgttcgtagtcatcatttttatgtattaaaattaaacgttcaaacactagatttttaagcaatcgctccagttaacgtgtctacttggtatttaaaccccaacttggctcttagggcggtcaaattcatcaaactgcacccttgccaaacgtaactggcacgagtacaattaacttaatcttaatggttacagagttcccgtgattagccccacggggattttttgtttatttaatttttaattggcattagcttaacaggtttcaacaaacatggagcacttctcccctttagccttaagcaaacaaaaagcagattaagccgcccagtggggtaacttaatctgctttaactaaacctatgtatgcgtttaactcgaattttcgactggcataatcccaataggtttagtataatattcctatcaggcaactagtgttgactacttttagtagttcatacgctagctagccatctataaagacgagcgttaaaggcgatcaagcatcagggtgcttggtttgctggtcaaggggttatttccagtaacttctcgaccaacgctcttttttattttcgctttttaaatatcttttgttttccacgtcttaaatatacaatacttttcattgtttgtaaacacttatttagcacaagtatactatcgctaacgtagtatacttgtccactaatccccaaatccactaatgcaaaagtggatttttataaaagtatacttatccattaatacacttttatatttatgcttgacataccagcgtaatgctttattattaggttgtagacaaaagtatacttatgaggggtgttgaatgtgacaaaagtcattgcactgagcaaccaaaaaggtggcgtaggcaagtccacaaacaatgttatgtttgccattacagttgccaaattatttaataaaaaggtccttcacattgatatggacttacaggccaacagtactttcatgctaagtctgacatttaaccaaacaacttggccagcatcaataaccaaatgccttgatgacaagaacttggaagagggcgttgtgcacctcacagacaatttagacgcaatcgcaggtgatagggatttccgtaattggggtacatggttagcagacaatgtcaaaggtactcacaatcgaactttttatttcaaacctttattagataacctcaaagatcgatacgattatgtttttattgacacgccaccagccactgatattaaagtagacaatatcatggttgccactgattatgtgatagttgtacaagagactaaacggtttgccttcgaagggtcaaaagacttgacgagttcatacttacaaacactgtataatgatttcaatgatgagattaatattcaagttgccggaattcttttagtccttcttgacaaaaaccattctgtcgaacaacgaattgtcaaaaagacgaccgaatattttggtaaagaaaatatatttaaccagattattaaaaatcatttgcgtttagaaaactatggcgaatatggtgtacagttcaacgactggcatgatagcagaatgctggcattgttttctgatctcttccaggaattggaagaaagaattgatcaatttgagaaatacggagatattaagcccagctatcaatatgaacctaaatacattattaacaatcgtctgacaactttaggcaagaaggagttgaaaccaaatggccttgattaagaaagatgccgacgctttacatgtaaaggtagaaaaaaccgttgatgacacccggaaacagaaaactgtttcagctaaggataggaaaagccttcgtgtcgatccagatacttatgacacaattaaaagtctggcatatatcaaagataaaaagatatatgagattgagaatgaaatggttgaagcctataaacgagataagctttctccacgagaaagagaaatatttgatagtatgagcagatcaaccaattaaaaaagtgtattagtatacttttccatcagtatactaatacacttttcagttgtagttattgatcttatttagttttatgtatttataaacgagtattcccttacaaatatacttttccattagtacaaaagtatatttgtatacttacaatcatttgaaatcagcaactctgtaaaatcaagtcctcaattttaactaaaatagttttagtaccggaacatcataacttttttccggatcaacattcattttgatgcctccatagataatttatgtatttatcatattgcttttaacgaacatgtgttccctattttgtgataaaatagatgtaaattattaggaaggtgagcgtatgtttttttgatcaagaaccgcatggggtgttctttttaattgataacaagtctttctatgcaagctgtgaagccgttgctcgtggacttaatcccttaaaagtcccattagttgttcttagtgaagctgaaaacaccagtggtgggctcatcctagccacgtcacccgaggctaagcagttatttcatcttaaagccaatgtctcacgcaaacgtgacttgcccaatgaccctagactctgggtcgtgccgccgcgcatgaatctctatatccaacgcaatttacaaattaatcagattttttatcaatttgcgagtgaaaaagaggtttgccctattcaattgatgaaagtattttggatatgacccattcatggcagctttttgggcagtctgtccgtgaagtagcaaggttgattcaaactacggtgcggcaaaaattaggcttatacaccaccgttggcattggtgacaatccggtgcaagccaaattagccctagataactacgctaaacacaaccatgatttaattggtgaaatccattatgaaaccgtgcctgataagatttggtcaattaccgaattaacggacgtttggggcattggcccccgtatggctaaacgtctgaaccgccttcaaattcacaatatgtatgagttagcccatactaacccttatttactccaacagaatctcggggtgattgggagccaattgtttgccaccgcctggggcgttgaccggacccggttaaccgaaccaatcaaaactaaggaagctagtcttggtaactcacaagttctcccacgtgactacttgacacaaaacgagattgaaacggtcattaaagagattggtgaacaagttgcggcgcggcttcgtcaccaccacaaactagcagcgtgtttatcactaagcgttggtttttcttatgctgcggctgaaaccgatggccgaaatggctttcaccaggctttgaaaattgaaccaactaatgataaccaagctttaacgaaacaattactgtggttatttcgtaagagctgggacggccaagccgtccgtaatattggcgtttatagtagtaagctcagtcctgacaccgggcagcaacttaatttattcgaatccccgcttaaccaaatccaacacagtaagctgaatcaagttattgatgatattcaccgacgctttggcttcacaaaactcgtctatgccaccagcctattgcccggtggtaccgctattgaacgggctgctttggtcgggggtcataatggaggaaatagttatgaataaagatttagatattatcacgagccgattgaccttgttgtttaagccgactagtcggacccgttattggctggtaattgccaatgacccgtacgatcaaacttacaacgtgttctttaatagtcagcaggctaatgaacgattaaggtcaatgcctttacacaaactcgctaattataatctcattgacttagaaaacttactaaattcgttgcgccagcagactaaattaacaattgaatttattggctttactggtcaggtttggccgcaaagtcaaaaaattattcaaaaaaggcgacaggcacttgaatgaaaagcgttttgacctcaacattgttaaccgcttctttgagcacgattaccacgatcgtggcctaatgaaatggcaaggcttttacttatctgatcacactgccgctttaaaccaacagaagatccaagataaacaacaatatccacccaaaccacaacagtctttaagtatcattggccaaatcttgtcaacagcttacacccagaaccaaccagtcaacttacaattaaacaccgtggatcaaaacaatcaacactttcccaccatcacaaccccaatactaggctataatgcggctactattgtgattgccaaccaccaatttatcaatattaatgatattcagcacatcgaattagtgcgctcaactaactggactggcaatcaataaagaccatcagggctctaattgcgaaccttggtggtcttttaataagtgcttacgcataacaactaataattaccatttatcagactggtcactaatgaagcaaagaaaaacatatataggacaaaaataactatggcaataatgaactgcactaatcctgctcggttccaggttgcttgcacggccttgaacgtcgcgacatcttgataatcacctttttgccaggcccattcattccctttaaaaccaaccacaaaaatccaaacgatattaaaaattggaattaacgttaataacggcaagtaggttttattgccaatgccccaaaaaacattgtacataaatgcgccccaattccaccctttgaccgcttgtggcacttctttaccattttctttcatcaattgcacccccaatactatttcttaatattagcttaccaaacctaagctggcttgtatactagtctagtatacgttatcgtgacatcggtttacgccgagctgctttaacttgggctagattcaagcctcgacggctggcttcgcggttagccaattgtaaactatgatttaccttggcaatctgttcaggagttaccgccttttgcagccgctttagtccattaacttgttgttttaagccagcgtttgttagatgctcattcacaaattgctgcgttttatcagtaagtttcgttgctaactttggcccaaccacattttcaagcgttatttcgttctcgtttaaagcgctgaccaataaattcttcaagtcatctttctcaacataatcttctgcgccaccttcgtagaatgtattaccttctttcgtcgaatatgctgaatactcatggcccacttcgtcataatcatagtgacggacaaaatcagccttagacacaatttcttttaccagcggcgtctggctcggctggatttcttctaaatctgttggcttctcaatcaatcctgcgttcatttcctgtaaactactaactggtcggtatgtttcctgcgcctcatgtggttttctcatacgcttctcacgctgcaagttccgcaccagctcatcactaatttcgatcgtcttattactaacttgttgaatctcactgagcgcttgatgaatcaccgtttgatctttagcccaggtggccacatatcccaacgagtaatcacccgtatcaatcccaatattctgcatggccacataagccacagcttctgcctgtgcttcctgatagccgcgcggtcgatctttaaaagctgatgttagtccatgtaattgactatgggcatattcatgatacaacgtctttagtcgcataccttgatctgactcctgactatcaatcacaatttcattggttttgggggcaaaataaccccgagcttgattttcagtcattggtcgctctgttacagttaaacccgttgttttgttaaggtaggtcttaaaagcttgataaagcggcgacacattcgcgtgttctcctagctccgttttgataaaatctctcgtttgcggtaactgctcaccggtagtgtgtcgcacatcaaagaccggcagataacggtaacccacaatggcctggtcgcgtttagttcctaactgccgttgttgttccggtgtcaactgtttggtaatgggtgccgcaatccgaatagctttagcacctttagtcacctgacgcttaaaatctttctgccattgtttaaaccccgccacttgagttgcttggggatcttgggcataaattaaattaatattacgtaagctatagtggtggaacttggccatcgtctttaaataggccttaaaattcgcactagtcgttaatgattggagcttaacttcagcctgatgaacaagctgttgcttccaagcttgaatttcagctcgacttttactggccatctacaacgcctcctgatctggaaattccgtttgtccatcaagtcggattaagtcatcgtcgctaccatatagcgggacaaaagtgcccgttgaggttttaatccaagcaacttgccgatatgctccttgaccaccaacttcgtctaaatatttcaaatcagctttcgtcatcaataccggtagttcactaccagctactgtcgttttatcagttgtcataaccgtcagctccttattattgatagacctagcctagcaactccggtaagacaacgattacttctaccaacaaaaagaagatcactaacctactggtcagtgatcttactgattaattaatgattacggctagctcgcccttctactaacacatttttcgtatagcgttaaatgggccaatacatagctaggcacttcatcaactgataagtccctaatttcaacgtatgctggtgactgatagtcaacacaagccattaaccgtttttgcaaggcgccccaatcctgctcttgcgccaattgctttctgagttgttcattagcggttatggctggttcaggtgtttctggtgcagaactagttggggtctcattgaccaacttaaccatttgttggagctcactggtggcctcattaccagcataatcatactgtaacgtggctaaatccaagcgtttatggggtgtttcaaccgcaatatcgaaaatagtggccgcatcatcaaaggtttgattcaagaattgccaacgagccggcatacgtgtccgcccagtatcaaaaattggattagcccgaataattcggcccttttgatcggtgcgagccgttgagcggatcaccaccatctcacccactcttagtcgtagtaattcttccatcgaaataactggcgccgcatctaagctactattgagaccgttcaagtcagccacattcccctgtaactggtgacccataacattgacggtcgtatggcccacttcatcactaatttcttgggcggtttccttatcttttgacaaaatatacaacgtattcccacagttactaattatggtttccgcttcttctttggagtaattgattcgcagttgccccttattttggagcacccaatcgaacaataattccgaccctaagccaatggtaaacttcgtatccaaattttgaatctttggcaaattaccaccttcatcaataataaagtgcacgcgattatagcactttttctcattgtccagggccatttgatacatctgattaaaggcctgatcaatagcaaacgataccagttgattataagacgggttatgtggtggcgttcctaagaataccgcaaccggttgttctgagtatttaaaggaaatcgattgcaggtcttcgtcagccattatcacagaattatcatgatccaaaactaagtcgccagcccgtttgaagctcgttgcggctaatggtgactgtttagcttctttaatctctccttgataatgatattgataccgccgtaacgctggctctgtcagttcatgattaaaatcaattgttaattgatagttggcgggtaaggtggtcttaatcgggaacgtcagaaaacctaaacggtcaaccatttgtgcccgactttccaacagttcaccttgttgatctgcaaacgtcacctgagccgtttgcagcgccaattgcttagggaaaccaattcttaatcgccgcggaaaagccatatcatgaaagtctaacgagttcatcgacgttaagcgagcaatatcgcgttgttgatagatcttaatgccttccatcattgacgcatagatattgccggcagtttcatcacccgcaaagtttgattgttgaaacgcttctaacgccatttcttggagtggcgttttaacgttaatttgcgccatctttttgaaataatatgacaaccttgtcgttaccgatccagtatcgtcttgaatctcttgcccacctaattcagttaattcccgataaatattattcatcgttacccgttcccaagtttggtgtcgcgcggccaaatcaagttggctgagaatcagcgcgtttaacaagttagttgatgaattattccaaaatttactgttgccaccgtcatcatggctctgataaatcgccgatgaaatccggttggcttcttgttgagcttcatcgtaatagccctgtcgtgcataatcaacaacaatcgctagtgggttataggccattgatttggccatgttttgcatatttaacacatagacccgataaccacgctgttttaacagtcgttctgacatggtaaataattcaagtttgggatcgttaatcatcattgacgactgtttttttgcccgtgataaattatcaatcaacggtaggacgatggtttcccctttccctgaacgcgtaatcccataaattaaactatgcaccgtggtttggtcaatcccataagtgccactcggtttgaagtcccactttttagccaagcgttgctttaagcttttgaatccccgactataactcgcactttgaatcagggccccaatgggcccgttataatgcactagtggcataccaccataaccttcaaatttctgattacgatccggtatcaattcatattgcttttttagttgtcccgggctactaaaagtttccgcgcccttttcaaaaccattataactttggtaagaccggataatccgataccagcttaaacttaatgcaataacacctaacaaaagcccccaaattaaccaaggattattaaactgattaccaggccaggctttcgtccaatctaatactcgcgaccaagttaatcctaagttcgtgggatcttgaaaggcttgaccgtgttgcaccaaccccttaaaccatagtttcaggccttgtaacagtaaataagctagccacgttgcataactaaaaaacgcgagtgttaccgctgaaactaatcctagaaaaccaaccactgccttgatattacgcgcccaccagggtgcattattttgtcgtcgccgatttaacccttgaccaatacttttgatgcccataattctaccgcctttcactgcgtttcagttggtggccgttgattttagggtgcgtttagtagcccgctaagcgcaccctaaaataaacggtaatgtttcaattcccctttagcatacttactgagaaattaaatagcgaaatctgttcacaaaaaaagcgtccttccgaagaagaacactacttaatagctaggattaatcaactgacgaaattcagtttcaccaatcattctaacctcatgctttaatgcccaagttaatttatgtgtggttaacttttcaaatagacctttatcaattacaccaactacaagtaaggttactgcggctgaacagtaatttagcaccttaccaccactatcaatcactaatttttgcgcttcactccgtgtataacctgttaaagtacccgtaaataacacacattctctgctcaaatctaaaattttcagctttgtttgcatcatgtcgtcctccttatcagcattatacttgctccgttaataaagacatcttttagccctgaacgacggcacaaattacaataaccatgaggaatgcaaataaagttttcaaattaaaaaagtacctatcgttagaactgtaattatggactaggtaattttagaacaaataaattaaggagaatcatagctatgaatgacaatatctttactactcccctgacaactgccttgatatctgaacttaacaagtctcctaaaagttgcgaactggcctatttaaaaatattcttttacgagcataatcgacggctttattataagctgaccagttcagaatgctcagctaacaactatctaagcaacccttttagttaccatcaattaccgcttgacgccaaacagttaggagcccgtaacataacaataatggtattcgttaaccaaattgctgaactatatacaattaaactgaaacaagttattgagagatgggtatttagccgtgtcgatgcagaagcttttgacgttttaacattggaaacctctcatcaagcacttcaaatagacattggctcagatatagcaaccatgacgtgggagtttgtcgatcccatcagctcggctgcatttagaaacctgataaccattaccggtaattcacattttgaattctctccaaagaagccaataacccgttcatcttcttcacaagcacctaaatacaatctgatactcacttggagcacggcagcttaacctggctacattacaagagtataattttataataacaacacttcttagctgcaagagtaactcagtatcattttgggagggagatattaaattgactatcatgcaaattatcggaacacttattgtcgggtgcttctttattattgttctaatggcattattacttaagacgctttccagataattaacatcactccaaagacattcttatctaatatctccagtttttttgcatactctttaattctgtaaatctgtcggcgaccaactttagtcattctcgatatctgagcaatactttcgtcatttttcaacactatttcattctgttacacatgttaccctcattcaatctcactagctatactaataactgaatcaaataaacacaaaatgaggtttaactatgaaaaataattctaacttaatcgtccgctacctgaaattctgcatctcttttatcttcttacttggtagattgtaaaatttttaatattggtcacgccaaagattcaacagttatcctaacatcacttactcagtcagtaagcggtgggcgttatcgtaaaagatcgcttgtttctgctcatttgttaatagatcagtcgttgctaaagcgtgacctaattgccgcgagccatctaacggcgtatatggaatatcactcccgtaaagtaggtgctcaggctgagccaagctcattaaagttggcaactgccgtggtagcacggctccagctacatcaaaataaacgtggtgcatcacatcgtaaacatccacctgataaaccttctgagcatattgtgcgattcgatcatcaacaattcccaaaaaagcaccagcatgcggtataatcaccttgatattaggatatttttcaaagaaatgatatttcaacatattaataaacgtcatcgtggtatccatgaagaatcccaacaatggcactggtaaatcaatatcaacgtttttaggcaagattgctggttcatttggatgcaaagccacaattgcttggcgagcatctagttcttggtagacccgttccaagactggtgatccaaagtaaagtccacgtgagttggttggcactgtgacgcctaaagcaccatcctggtccaaagcctgttgcaccgttttgacagcatccagttcataagggattggtagactcgccaagtatcctaattgatctggatattgctgggccaagcttttaccatcgtcgttagccgcttcaactaagcgtatggtttccgccttatcaccgaagttcacgtgtggggatgatagcgataaaatcgagtaactaatatcattatcacgcataaagttaagcgtaagctgtggtgtccactcaggtgtcggccagccatcaggatcacctggaacatgacgctttagtgcctcaacgtaactcgttggtaaatagtgggtatgaaaatcaatttttgacattagctgcacctcgttttttagaataaccatagtctaagaccaaacgagtgcgttggaaatgtacaattgaggtcaaattgaccatttacaggaggtgacatgatgacaactaactatccgcttgccgtacagaaaatgttcgcaactgtcccagcactactgacagtgacccccatctttaaattgactgtcaccatggtcgtcaaagcagcccacgttagtcgtgggagtttttacagtcactttcaagatatttacgacttcattcacgctttcgaacatgctttaatcgaacaagcaaccgtttcaaagcaagtccttaaccaagggattcaagctgccctggttcatcctgacccgcataatgcttatccaacctatctggaactaacaacgaatatcaacacccaattggctagttttcaggccttgcttggcccccatggtgatccacagtttcttgatcagcttcaggccggtctcattgataatttactcgccactactgagcaggcgcccttaaatcatcaatatttccagtcgattccggctgactacgccatgccaatctactttagtggcgtgctgacaattattcagcgctggctgaccaaggcccatccggagccacctgaagtggttgccaacattatcgttcagagccgctacaccgcagcttaccatctcttttccaatcgtccgcttggggacgatattaactagaaaccaaactaaaaactggtcataatcccataattgtggattacgaccagcttttagtcacgacagtcaatacttattatattcagtgcatggtcacgatcatttgatcgccccacacttccaactgatgcagttgcttttgaaaactaacgcccgcagtcgtcaactgaaatcgatagttccctgcagtcgcaactaatcctaattcggttaatttagctaaaacattcagtagtttaagcgtgctaagacccctaactcgctggcgcaaattcataatctcagttggcgccgcctttaggttgatcagcactaacgcagcccaccggtcattgagcacgcctaacccaactttcgtgccaatatttagatcacgcattaccatcagtccatacttccttacttagaatttataatcattataactattctaagtaagtttgcgttggaatgcgaataacttgcttgccatcgacttttcagacttttatttttgaatgtccggatacgtctgacaaaagtcaacgaccgctccccgtaaattagcttcatcggtgaaatgacaagccacaacatctggttttatagaagcaattttgaccgttgcccgcaatttttcgatttcagcattgattgctgggagtaggtgcggattatttgagaccgccccgcccatcacgatcaattccgggtcaaagctgtattgtaagttgtagatggcccgcgctaaggcccgaaccataacttgaacttcggcttgagcatcagtatcacccttggcagccagttcaaacacggcttgcccgtctagctcaggttgagctggatggctcgcgttgtaccgcttcgcaacagctaccgcagtacctacctcacttaagatctgatggtcattcatgagcgtgaatccaaactcaccaccaaataagtgcgcaccgtgccaaatttgatgattcacaatgaccgacccaccaacaccggttcccacaattaagaagcacaggctagcaacctgtttcccagccccatccgccaattcagccaacgccgcacaattggcgtcattttccatactgaccggtaattcaaaacgtcgttgtaattccggctgaatccgaaaattatgaatatacggcagtgcgctggcaccctcaataattccagttgccttattgacagccccgggcgaactaatgcctacaccagcaatttgataatcgcgtttcatctgcgcgacttgcgtggttagcaaagtgtaaaattcagctagcgttgtgggcgtcgtaactttagtcttagcaactaattgctgatcttgccacacagcaaacttaatggtcgttccaccaatatcaataactcctaatgactgcatcgttttatcattcctttatcaattaaactagttatcataacaatgatagcgcttaatatataaaatgtatattcttttataataacaatccatcccgacatatttcatcaaattatgcttttctgaccgatactagacaacaaaaacagttgattgccacgtgcccacgtcatggtaaccaactatttttagttaatctttaaattgaattttaacgtaatcccgatagagtgggacgttcgccattagctcttgatgcgtacctgaaccactcacatgcccatcttcaatgaagtaaatctgatccgcatccacgattgtgctcagccgatgggcgatcactagggtcgtccggcccttcattaattcgccgagggcttgttgtaccatcgcctccgattcagaatccagactagcagtggcttcatcgagcattagaatcttggggtcccgtagaaaagcccgtgcaatggctaaccgttgccgttgaccaccactgactttaaccccacgttcgccaacttgcgtctcaaggccatctgccatggcgcgtacaaagtcagccgcggaagctaattctaagacgtgccacaactcattgtcggagtataaccgatcagcaccgtacgttaagttttgacgaatcgtaccggccatgattgccgagtcctgactgacatacccgatttgtgaccgccaactattgagacttagttcattaacatcttgcccgccaatactaatttcaccagcagttggttgataataacgttccagaaggccaaagatagtcgacttaccaccaccagatggtcccgcaaacgccaccactgtatttggtttagcttcaaaactgacatcgtgtaaaatttgttgatcatcatcataggcaaagtcaacatggtgcatcgccaaagtctcattggcgactgcgtgttcaacaccaaccgtcaattgttcttctggttcattcaataactcccgaatccgtgccgtcgagccactggcctttgctaacgtggtgaagaactgaccaagcatcccagctgggccaatgatttggaacagatacattagaaatgagaccaaagtccccatcgtcatcgttccactggcaacccgcgcagacgcatacaatagtaccccaacgaataacgccatcatcgttgccgtcatcactggacttgagatggaatcataaatggcttcgcgtagtccaattcgatacaacgtcttgatctgatgtgcaccagtcgttgtttccactggttcagcattggacgatttcactaagcgaatctcactcagcgtttcttctgccgtcccgctaaaattagctaaagcatcttggcgttcatgaccaatcttgcccgtctgccgcatgattggaaacatgactaataagacaactggaatcgccaagaccataatcaaggtcattcgccagtccattaagaccatgattgcgatggccccaaccagttgcatcagtgacgtcacgacttgtggaaatgcgttagcgagcaagtctttgatctgcgtcgaatcattcaccaaccgcgacgtcatctcacccgtcttaacgttgtcaaagtagcgaaccgggagccggactaatttatgccataaagtcccccgtaaattagcgacaacattttcaccaaaaatccccaataaggaacctgataacgcgctaatgactgcactgatcaagaataagccaatcacaccaattagtaaggtctgattaacgccgtgactaaacccattaatcaacgtttgggcaaacttgggcaccatcaactgcgcaccagtcgccaataagcctaatgccaagcccaaccagagttgccaataacgagggctagcgtgccgaatcaattgtaagaattgttttaaatcaaatttaccacccgctggacgcgagtatgctgcttgtggtcgttccatctgctcttatgcctcgtgtttctaaaatttaattaaaccaatgatgcccatgaccccaaccgggacgtggaccgaaaccgtgttgttgaccaaattgcattaaatcttgaatatcgatgtcatccgcattggcccgcaacttatctaataaatgttgtaactgatcgcgctcatcatccgtcagattaccaaataactgatccgccagatcactcgttccttgcgcgcgatggtccgccatctcacgaccacggtcacttaaccgcacgatcaccacccgtttgtcatgcgcacttggttcgcgttcaatcaagcccccgtcttctaaccgattcaacgtggcactaactgaacttggtcgaatatccaagatctcagcaatctcagcattggttaaaccagcgggtgcatccgccaatacccgtaaaatgcccatttgaccacgcccgccacgctcagaaccatggtctccaaaatgaaattgttgggcaaccgccatgacgaaggcccgattttgaaataacttcccaaaactactaaataaatcacgattattaactgtcatgaatttttgtcctccttgatttgaatgatgcttatgttagcacgatagttagacaaacgcaacaaaaactaactaattatataaacatttttttacctgtccaatcgcgacttcaccgcaactatcattaacgatattgcttttacctcaattatcaagactacgatttgcacgataacttaaaagtccgctctttctgaccagcagttctcagaaagagcggacttattactattcaatttagtgtaattaattattaatgatgagttcggccggcaaagcaatactttgcggatgttcactgattgctaattctaatgcccgagctcccacgacttcaaaatgatgatcaatggttggaatgcccaacacttcaccagacaactgatgctcctgcccaatcaaaagtggaacaggccgttgcgcagccaaataagctcgacgcatccccactgcaatgtcatcaccattagtcagtaccgcggtcactggttcagtaagttgggcaaaataggttccagcatgctcgccatcttccgccgtaatgattccggtatacaataacttcggtgacaatgtccgctgataaacttgttcataggccccaaccatcgcctgtgtcgtggcactaacctccagcggtcgacttgttaatatcgcgattcgctgatgatgtcgctgttttaaatacgtaaacgcctcaacatacgtcgctgtacgctgggcataggcagctggtaaagaatagtcatggggattttcacacaatacgattcgtccgtaacgctgataaactgcaagtttttttaatggcaacccgtgggatgtaaaaatcagtgcatcataagcatgctgacggagtgcctccaagtatttcaactctaattgcgagtcccatttggatggtagtaatacaatgtgataattcgcagcaaaagcagctcgcataattccatgtaacagttgagtaaagtatggatgatcaacatgcggcagcacaactccaatagttaacgttgccccccgactcaggttacgagctacggcgtttggaacataatctaatttgttgattaccgcttcaatatctccacgagttttggcagaaacataattttgatgattcagtacgcgcgaaacggtggaaactgaataaccagacaaacgggcaatatcatgaatgttcgtcatcaatattacctcccgattaaatgtgacaaggcgtaagccacgccatcttcatcattacgtttggtcacacgatgcccatattgctgaatagttgaatcagcattgcccattacaattggtaaaccaaccgccctcagcattggcaaatcgttttcaccatcaccaaaggcagctatctcattagttgttaaatgatatcgttctttaataaatgcaattccacgagacttttgtgcctgagcactagttacttctaaatacgtctgtccagataatttaacactagcgtaactaccgaccaattgtttaagggccattgcgagtgttgccataacatgtttgtctaaggtcataatcataattttaaaaatagctgcaggatattgccgaaagtgatctgtataactcgtaatcggtgtcactatttgtcccgtcagctgctgttctgtacgagtcccagcatcaactttttccgtcacccaatccgtttgcgtgtaacagctcaggctaactgtcggcgactccgtcttaacaaactcgagcacttgtaatgctaatttctgatctaacggggctgcttgtaacgccttaacttgattctgacaatattcaaaaatcaaaccaccattaaagccaatctgggggcctgttaaccctagtgcctgaattgtatcacgcatttcaataggtgcgcgagctgatacaagcgtcattggtaagccactttctcgtactgcttgaacagtttgtggactcacaattccttgggaattcaatagcgtcccatctaaatctgaaaacaaataattaatcatgccaatgtactcccgtcaattattttattaatcttacccttagtatacctgctcaaacgcgttcgagaacaagcccgatgacaaaaaaactcgcgatattttcgcgagttaaaaaggttagctcaattaaatgaagtcggtaacctgcgtaccagcgtaacgcgttgtcgtgattggttcgctagccgccttgccaagtgcaatagccatcactggtacatagcgcttggcatccaagccaaaggtcgtcgcgactttatctgccgcataacccgcaattggattagcatcatagccatgtgcgcgggcaatcaatagtaattgcattgcggccatactactatcaatcatcgcatcagcttgtagaaattctggactcgcattttcatacattggtaagaacgtcttgaagatttgatcccgcttttccggggtaatgcgtccttcttcacaagctttattccacacgtcccgatagaccaaatgcgattgcgtatcgcccaggacaaaaatcatggctgaacaagaatcaatttgtggataattaaatggcattaaaaccgacttcgcctttgccttaccgtccgcactatcggcaaccacaaaatgccaggattgcaagttgcatgctgatggtgcgctgattgtctcatcaataatcgtttgcaattcttcacggtcaattttgacagtcggatcaaactgccgtactgattggcggttaaacaccacgtctttaaaatcattatttttaatattagtcgtcatggttgttggcatcctaaacaactccttttttaaaagtaacaaattcattaatcaatcttattataactgattttgtatttgttttcacaattattttgaaatcgctatcattagcatctattattccgaccaatatttattttttatgctcattacctggggtcatcgtttataccagtattacttatgcttgtcggacttgtagttccgtatttgtatttatattagaccactcccaattgtactgttaatctcattaaaccaatggactataccaataaaaagcggttgtaatagcgctttcagcaccgtacaataatgattgcacttattcaaaactatctttttagggggattttgtacatgaagaattatttgcaacgtatggtccgttcactgcaattacccgttgccgttctacccgcagcagctttacttgtgggaattggtaactggtgggcatctgctagtaacgacatcgtcgcgcacttcttacaagccggtggtaacgctgttctgagccaattaccactactatttgcagttggtttggcactcggtatgtcaaaagataaagatggcgcagccgcccttgctggtttagttgcctttgaattaccaactaacgttttaaagccagaagcggtcgccacactcttgaatatcaaggtaaccactgttaatccagcgtttggtcaaattggcaacgtcttcattgggattatctctggtctgattgccgcagctctttacaatcgcttccacgagaccaaactaccgatggctctttcatttttcagtggtaaacgtctagtcccaatcttagccgcgctgaccatgttattagtcagcgtcgcgcttctcattgtttggccgcccgtctatgatgcgttagtgacttttggcaaattcatcgtgggtctcggtgccgttggggccggtctctatggcttcttcaaccgcctattgattccaactgggttgcaccaagcactcaattccgttttctggtttgacgttgctggcatcaatgatattggtaaattcttagcacacaaagggatcaagggtgtgactgggatgtaccaagctggtttcttcccagtcatgatgtttggtttaccagctggggcctacgcgatttaccgcaatgcgctaccagaacgtaaagttgaaacggcgtccctgatgatggccggtgcgtttgcgtccttctttaccggtgtgaccgaaccattagagttctcatttatgttcgtagcttggccactctatgttttacacgcaatcttcactggtttatcgctagcctttgctgccttcatgcactggacagccggttttgccttctccgccgggttagttgactacattttaagccttaaaaacccgattgctaatcaacctttaatgttgatcctacaaggattggttctagccgtcatttactactttggctttgacttcgcaatcaagaagttccatttgatgacaccgggccgcgaaccagtgacagccgatgacgccgatgatttagccatcgccactgatgcggatgatgacaaatacacacgtcaagccaagcaaatttacgctgcgctcggtggtgccgataatttaacggttgtcgataactgtacgacccgactccgattgcaattagccgatacgtcaaccattaatgaagccgctatcaaacacagtggtgctgctggtattaacaaattagacgaccataatctacaaatcattattgggaccgaagtccaattcgtcgccgacgcgttgagccacttaaagctcacgaacgcacccattactaagaccacgactagcaatgaagctgttgcgacagcaccaactgcgactaatatcactagtggtgtgaccaccgacttttacagcgtcgctaacggccagtacgtagatattgaaaacgtcgacgacgacacatttgctaagaagatgctgggcgatggcttcgcaattgatcccgcagacgggacgattacggcgccggtcgacgggacggtcagcaccgtctttcctaccaagcatgcaatcggttttaaaaccgattcagggttagaaattctgctgcatatgggtattgataccgttgagttgaacggtgctccctttgaagtactagtccaagccgatcaacccgttcaccatggcgaagtagttgccaaagctgacctggcagcgattaaggctgctggtaaggccacaaccatgatggttatcatcactaacatggatgctgtcaatttgatgaaattcaagatgttgaccaaccaagtcaaagtcagtgatgagattatgttggtcacgacgaaataacttgttgcatgcgccaattatatgaacagccccctacgtatttgatacgcagggggctgttttcgataatcaaatcgccggacaattctttaaattttccttaacgtaactcatttgccatttagcaacgtttaccggcaattatggattattcaattaacttatttttccagaattatacgtcatatgaatattatcgccacgaaactaatatggtatgctaaaacgattgtcacctagcctcggaagtcggacgaacacgtgttgatgaactgcaatctaaactaacagcacgccttaatcatgatttgcacgaagcggtgcctaaccgaacctacaataattatattttggtattgctcagcatgcgctaagctagaaaggaagaccaatgtattttggcgatttaattttcattatatctatcatcggtggtctcatcggtttaggactgatcatttatttgattgcgaaattcgttaagtaagataatgacctgctaactgatcatcggccgttgcaagtcgttttttgcaacgacagcctcacacctcagctgcgaacatcgtcaccaagtcatccgtccgcaatgcttgcttttcggcaccacacacgtccaacttgatctgaccatcctgtaccatcactagccggtcgccgtatgtcaacgcatcgctcatcttatgcgtaatcatcatcgttgtcagatgattggccgtcacgatttgttgggtcagcgccatcacttccgcactcgtcttcgggtcaagcgccgccgtatgctcatccagcaacaacagctctggttggctcaaggtggccatcagtaaggataaggcttgccgttgccccccggataaatacttcacttgcgtattcagtcgcgcttctaaccccatattaagactagccagcaaccttaaatatcgttcttcctgtccacgttggcgataacggcgcagactcaagctccccgtatgacgttgggctaacgtgagattctgggccacacttagttcgccagcggtacccaacttaggatcttggaacacccgggccacccaccgtgaccgatacgcaacgggacgattggtcacacgatgattggctagtgtaatctctccagcatccgtatttaacgttcctgcaatcgtattgagcaaggtcgacttgccggcgccgttgttcccaataaccgccacaaattcgccaggttcaatcgttagattcacgtcctttaagacgtgccgctcgttgctggttccgggaaagaagactttttgcaagtgttggacgttcagaatagttggttgtggcatgttgatcgactccaatctctttaaggtaccggcgtaactgccgttttgtccggtatttattttgtaatagtggcaagcagatgacgatgacaagaatcgccgctgataaaatctttaagtcattgacggggaaacctaagcccattgccaaagtcaacaaataacgatagataatggcgcccacgaccattccagtcaaacggacccagatttgacgaccatgtaagaagatttcaccaaccaggactgaagccagcccgatgacaatcgtcccaattcccatcccaatatccgcgtaaccgttactctgtgcaatcagaccacccgataaagcaatcaaaccgttagataacatatagccaataatgaccatccgatcggtatagattccattcgcagcactcatcgcaggattattacccgttgccatcaaagatagtcccaaacgcgtctggaataaccaaatcaacccggccaggacgaccagcgtaaccacagacccaatcacgatggtttgtaaattcaaagaccagctcgctggtaaccatcccatcaacgttttctggtcaagcaagggaatattcgctttgcccataatgtgcatgttgatggaatatagtcccgtcatcgtcagaattccggccaataatgacggcattttaagcttagtatctaatacccccgtgacccaaccggccaaacatccggcgacaaatcctaataaactcgccacgatagctgactgtccggccaacatgctactaatcgtcacggcagcccctaatggaaaactaccctcggtggtcaaatcagggatgtttaaaattctgaaagtgaggaacaccccgataaccagtggcgcccataataaaccttgtccaatactcgtgattaacatattacctcgctcccctcttatggttgcttgattgtacttggttgtaagccgattgccttagcattcgctttattgacgtagaggtgtaacttgtcagctgtttgaaccgccattgtttgcggcttctgcttcttgattaagacttggtaagccatttttccagtctgttcacctaattcgtaatagttaagaccatacgtcgcagtcccgccatcttcagccatttcaatcgaacccgttaccactggtagctttgcagccttggtcttctgaccaatcgtcttcatcgcactcgccatcaaattatcggttggtaagtaaaggccagatatcttacccgtcaaaccggccaaaacactggcaacgtcattagtactcgttgcgctaacgacctttaagttgataccgtgctttttcgcgtaagccttcgccaacttgacttgtagcactgaattttcttctgacgagttatacataatccccaacggtttattacctgtactcatattcttcaataactgtaattgtttgccgacgggcattaaatcgctcgtgccgctcacattagtttggggcttcgtatcacttttcaccaatcccgccgctttcaaatcagttacggccgtaaccaaggtcggcaccgtcgtcgttttcttggctaatgcctgagcagctggcgttgcgatgccaactaacaaatcatttttctgttggacgagttgttggctcattgtattcaaattactctgatcaccctgtgcatttagatagtgatacttgaccgttactttactgttatgcgcttttaattctttttgtaatccggctttgaaccccttgcgcgcttggtctagtgaaccatgttgaaccacctgtaagatgcccaccgacacgctttgctgaccactcgttgcttgtttgccacaaccagctaatagtaacccagcacctaaaattaatacccctaaagttgtttttttcatcttgaaacgctccttaaaaattgtctggttcgcccaacgttcatcaacgtcttgatgaaccggactgaaaacaaaaaacaccagttagattctgggaagaatctaactggtgttttatcgggcccgatatttttccagatagattgtccctgcatctacctggcgtttaagtcatgttgaataactttagctctcgatagatacaaacgcgttgcgtgcgcttgtatccatcaaacgaatacaaacgctatctaaagaaaaagctaaaggcaaattgattatttaattgaaggttagttgctaatgacatattagtcatcctccgtttcaatttatagctaatagtaaaccatgacgacacctaacttgtcaactgcgaaccagtaaaaaattcaagtgtaactggtcaaagtccccgtcacccaactgatacacgctaacttatttatctggcgtatcactcagagtccaactcaaggtaccttgataagtatcagcgtaaatacctggttgcgctgataatccgattcccttcgttgtcgaccaatcatcagtgactaccgtatcggtcgtccccgcgactttttgtccctgttggaccaacgtcgcttgattcgttaagacggtctgtgcactaccatcacggtaaaccaaatcgcccttcaacgtccgtccactgaccgttgtcgatgtcagcggcgtggcactaacgtacaaataccacttagccccggtcgcccgggtatcagtcacactgatggctagtggattagtcggttgatagacttgtggtgtcaacggcacctttaaatcgccgaagctcatattggtcgttaattgaccaaacgacagcgtccctgctaacttagttacttgtagtgcaattttatcagatgttaagccgctggcgctcgtcgcatagatgtggaccgtggtactctgattatcagcgagccccttgaataacgcgaccagaccgctctcactcgcatgataagtcatcgtatcattagcattactaggattcgtcgcaaccacgccagcctgcttaactaaccaattaacagcatcgctatcagacgttaacgccgctagatcactcacggacaaattcaccgctgtgctgctacttttgattgtcagcggtggtatcgtcacgtccttagtcaccgattcagattcgccataatcggcttctcccgtctgcgttactgtgactgaagtgaccccactgaggccatcatttaacttaatttcatatttaccatcactaccgattgtcgccgtgtacgacttaccattaattgtcgtgctgacggtattaccggcaatcccagttcctgtcagagtggtatccgtcgttgttggcgtattcagcgtcgtattaaggctaatccgattaaacactgccaagcggtacgtggatgtctcaccctttactgtagttaatcgaaacccaatatatactggcaaattatcctttaacttactcatatcgactgtcaaagtcttgctagtattcatcgataccgtactagaaccagtcgccatatttgtcggagtcttggtcactagtgaagttccaaattcttcggttgcttgcttataaaagacatcgtaatatagcgttttaatctccgaactattcgcaaacaacgaaccactaaaggtcaacgttattgtggtagtcttagtcgatatacgtccctgatccgcatagttggccgtcactttggttaagcttggatatatcccaattccacccgagatattgaacccaacgacatcaccgctattaaagtaagtgtagtacttattactcgaattagcgattgtcgttgtcgcagacgtcacgggcgccgctgcctgactcgtaatcgctagcatgctgataaacgctaagcagctcagtaacagcatgcctagcttaatatgccgcagtcgtttcacgtgttcgcccccctttcacgcattaacttaagcacctgccaccctaataagagtgccattaaggtcaggaacccgagccactgataatagtgattcgcttggaccccggtttggggcaaacggcccgttgctagtacctgttgccactgaccgacaaagcgattgggcgcggctttgacagccttcgttgcgtacacaacgtcgccctgcggaatttgttgcaccgtcgtaggcgtttgtttgtccgctgaacgtgacgtatagaactgtatttgtgtcgacgaagtgcccaccgtctgagcagctcccccgatggatggtcctaggccaattaataagcccagtaagccccgtatcaacagccatcgcatcatttgtcagtcccccttttttgcccagctactaattgttcatgacgcttagcggccccaaactaaacaccgagccgattgctgttagtcttgggattgccgccgcttcttcaagaaaagcactaaccacaaaatcagtaagactacaatcaacatgcccagtgcgcccagaccaatcaaccaccagatactgatgccgttatcatcaaccgtatcctggttatacgtcttagccgtggcagcactaatcttgaaatcgcggtcaaaagtccacttatgagcgctattgtgcgcaaccaagtgtaaatgatacgtccccgcttgaagcttctgtttgttgagtaacaatgggtaattaaacgtcgtattaggcgccaacatcacgccttgtttggtcgcctttacgacggttttgccactatctttggctgtgaccgtcgtcttcatggtaacccgtggtatcatcactgctgcagtattgcgtaacgtcaccacgatactccggtgataattaaccattccagcagcgacatcgcttagtttcaagacgggcgtgggcgcagtccctaagctgtacttgatgcccaccacataagaatattcactgctaatattcgtagcacccttcacttcaccagtgaccttttgatcgacgcgtttaaaataccaaccacctaacagggcaccgttaaaatccttagtcggcatggtcgtttgggcactgaccagcttagaaccgttggctggaactgtcaccgtcgttggccccttgattttagtcaattggtcgacccgatactgcagtgaggcatcatactttttcgccggggtcacgtattcaattgcgccgccactgttggtatatgccgtatgaatccccattgcaacgcggatatcccggttagtcgtattatagattcgcgtctgcaacgtttgggtctgccctgccgtcattttgaggtcaaaaaacgttgcctgtttatcaatttggtttttcggcgtttgggccgcgacactaaaaccaatattattactggtgtccgtattggctgcctgtgctggaaccaccgcggacaagccgctgatcatcactaagatggcccctaaccaccgcatcattttcttcattattgcgtcccccgtcgattattatgtaaaagagacgcccactattacgtggtcatctccaagttcattaatttaattatctgctgatgatgttaatgtccaatttaggacgcccttgtaagtcgtagcggccgccgtgttagccacgacgttcaacttgactgcagccggatcaagcaagtcagacgtaatccccgccccactcttatccgctgctgtcatgacattcccagaagttgtccccgtaaaggacgccccggcactagttgaagcttgactacctaagtcaagttcaacagcttgtccgaccgcaccattaccaccggtactgccgttgctagcttccgatccggaagaaatgaccgtccctgcaggtaaggagaccgtggcccccttaagcgtacttaagttaccatccgtgccatccgcagcggcaacactcaatgtccaacccgcattcgtcccgcgttgatcagagacttgtaaaccaactttacccgttgaccccatggtgaccgtgctaccatcgctaccagtcaatgctttatagctttggttattgatcacgtcaatttcatgcgaaccgaaatcaagtttaccgggcgcatagatcagtgacaaaccagcaccggaattggcaccgttatcgccatcaccaggcttagggtcaagtggtttcgttgggtcagtcggatcgaccggatcaactggattagtggtatttgccgtaaacgttgccgttgcattcgtcgtcccactccgattttcaccatcggccgcgtgaccaacgattggcgttaaggcccccaataaaatggtactggtcatgagtaaactgcctactacttttttcatatcgtgcatcccctttagtttgcctaattcattaactgcactaataatttaccacacttcccaacaattacaaccccttaatctttgagttgcttctttgttaaccgacgaaaatcaacaagatcaactgttctggccatatttagtgttcggtattaatttttcgttaagtcactattaagtgagaaaacggttcaatcgccgctttgttaatatttacacaataatcactaagtcatcacatcgcattgaatcaggtcaataataaatttttttattgcaagggtccggttaaacttattcttcttgattacgatcacttggttatcaaattcgtcatctaactaaaaattctgtgtattcctcataaccgccggataagaatagcgccatttggtcttcaccattcctcgtaaacacgagttaattctgccataatactaaccgaaaaaggccccaggtcgctgtcacaagccctaatctgctcacttctaaccatacttttctccaacatcgttgacccatcagcgatttattggcatcaccatcgaaaaaaagactcaggatggactcatcctgaatcttttttaatggccgcacatcttcgtcatgtttcatcacataatcaggtacggtacgtaatgttcaactgactaatcgctgaccggttgtacttcaaaccccgctgccgtcaaaacttggttaacatcggcggcccgttcactattcacgtggagctcaatcactttttcagcctggtgattcacgaccattaacgtctgaatacttagatcgtgttctgctaagacttttccgatggcaaaaattacgccgacatggtcatgctggaccaccacccgggtcacgattcccggctgaccgtaaccagcaatatttaagaacgcatccaagatatcattattggtaatgatgcccacaacttggtcgcctgtcatgactggtagtacgccaatcttatgtttccgcatcgtagcaatcgccgtttctaactgcgcgcttgatgcgacggtctgaaccgccgtttccatgatttggtccaccgtcgtcttattaagtaagtagttcaattcgtacaccgacaaactcgtggcttgtgatggcatcgcgcgctgaatgatgccatgcgtgattagaccgaccatttgattacccgccatgaccggtaaccggtgaatcgcattcttcttcattaattcaaccgccacactgatcgtcgttttaggactaacaacgaccaggcgtggtgtcatataatctgcaacactcatacttaaccccctagataagctttctgaacttctgaattagctaataattcggaaccccgaccactaagcttgacttgtccactagctaagacatagccgcggtcagcgattttcagggcttgattggcattttgttcaattagtaaaaccgtcgttccagcctgattgattgccttgatgatttcaaaaatttcattaataaagatgggagctaaccccattgaaggttcatctagcaacatcagcttcgggtgcgccatcagcgcgcggcccatcgccagcatttgttgttcaccccctgagagggtcgcggcatcctggtgccggcgtttcttcaagattggaaagtagtcataaacttgctgataagtctgggttaattgaccacgatcttgccgtaaaaaagcgcccatttgtagattttcttgaacagatagcccggggaaaatatggcgtccttcaggaacttgcgaaatacccgcccgcacaattttaggcgccgccgtcttttgaatgggttgatctaaatagtgaatggtcccactgaccggccgcatcaggccagatatcgtgtgcaacaacgtagatttaccggcaccgttagcaccaatcaacgtaacgatttcaccctgttgcacgtcaaaactaacgcctttgactgcctgaatcgcgccataattaacgactaaatcacgtactttaagcatttacacccctcctagataggccttgataacggccggatcatgttgaatggcttgtggcgtcccagttgctaacagagccccatgttccaatacgtagagccgttcgaccacgttcatgactagtgacatgtcgtgttcaattagcaccacggtaatatgaaactcttgttgaatccgtcgaatcaagcgcgtcaaatccgccgtttcttcgggattcatacccgctgcgggttcgtcaaggaagagtaacttgggcttcgtcgccagggcccgcacaatctctaatcgccgctgaataccatatggtaaactctttgcgggctgatcagcgacggcggtcaaatcaaacatcgctaataaggcttgtgccgcctgggtcattgcccgctcagtctggtaatacttaggtaagcgcaggatgctagtcaaaaaccgttcatggtaatgattggtcattgcaatgcgcacgttatcgagaacactcatctccttgaacaaccggatattttgaaacgtccgtgaaataccaacccgagcaatcgcagcgggctgcttgccatttaacgacaccacaccctggtccgtgtagaaactaatgctacccgaactaaccggtgtttcaccagtcaacaagttgaataacgtggttttgccagcaccattcgggccaatcaaaccaatcagttcgtcttgatcaaaatggagtgaaacgtcagcaacggcggtcaggccgccaaagtttttgaccaacccttgtgcgtctaataaccggctactcatggttaaccgcctccttagttgatcgccgtctgaatagacgcgtgaatgagaactcccacgttcctaacagtccggctggtttgaaaatcataatcaaaatcagtgccaatgaataaataatcattcggatcgtaccgaagttttgtaggaccgtgtcgagtgcgcctaatacgattgcggctacgaaagtcccggtaatactgccgaccccaccgaggacgacaataatcagaatcgcaatggacgccatgatattaaaatcacccggcgcaatcgtttgaatgtaggccgcgtgcaacgacccaccaatcgccgcagtcgccgcaccaaagacgaaagcggctaacttccagcgcgtcgtattgattcccatggcaccagccgccagttcatcatctcgcacagccatcacggcccgaccaccgcgactatgaataaagttgaccgtgataatcgttgtcagacacatcaaaacgtacaccgttgcccacgaagcaagtgccgggatattgaataaccccgctgcaccgttcgtaattttcagattattgattagaatccgaatgatttcggccgcccccatcgtcgcaatggctaagtaatcaccgcgcaatcgtaatgttgggatgccaacaatgaccgccgctaccatggcaatcaccatgccgacgatcatcgacagataaaatcctgcgggcgtcgccattgtttgggtcataataccagtcgcgtaggcgccaatcgccataaagccagcgtgaccaagcgagaactggcctgcaaacccaataatcagattgagtcccaccgccaatataacgttgataccaatcgtcaccagcatattttcaataaacgagttaatgacgcccatcagctctaaaccgtcaatcacaacaaagccgataaccatcacaccgagccacgccatgttagttttcaaatttgctttcattaatttggcgcctccctcagactttttccttggttcgtttaccgaatattccagccggcaacacgagcaaaataacaattaagacaaagtaaaccaccgcgtccttgtaagcggataggccaatcgcctgaacaccagtctccaggatgccgataataaagccccccaatgaagccccaggcacggaaccaatcccaccaatcacggctgcgacaaaggccttaataccaggcgtcatgcccatcaacggatcaatcgaattatagtataggccaatcaggactccggcagcgccagccattgcggaccctaatgcgaacgtgaacgaaatcgtatggttaagattgatgcccaccaactgtgcagcctcgggatcaacagaaacggcccgcattgctttacccattttggtacgtttgataattaattccaatagaatcattaataggcacgccgttcctaagatcagtagctgcacattcgatacccgcaatccgccccagtgataagtcaccactttgattgcttggggaaatgaacgggcactcgcaccaacaaagtatgacattccattctcaagcaagaatgaaacaccgattgccgtgattaacgcggtaattcgcggtgaatggcgtaatgggcggtacgcgaaatattcaataatcacaccactaactgcgcagatcaccattgcggacaggagcgccgcaacaaagttaaagtgtagtgacttcaaactgtaatagccccaaaaggcccccaacatataaatatcgccatgtgcaaaattaattaatttgataatgccataaaccatcgtgtagcctagcgctaataacgcgtagatacttcctagcgatagtccgttgatcaattgttgtccaaatgtctgcatatgtgttcccccacgctttcactagtctgactatttgacgttataaaccttgctgaccacgccattcgtcaattgttcaattgaaatcgtcttttcaggattatgttgcttatcgatagtcgtcgtcccagtgacacccttgaagttcttaagtttggccaaaccatcggcgattttaacagaattagccgagccttccttttcgatggctgctttgatcatataaaccgaatcataagcgagtgctgaaaaagttggtgcagtactaccatactttgccttgtaagcactcataaatttcgaagcaactttgttcgttgccgaagccttagtagaaaatggcgtcgtgtaataaacattggtagcattagacttgccagcaatttgggctaatttagcatccgccatcccgtcactaccaacgattggagccttgattcccgcttgccgcgcttgcttaacgattagaccgatttctgaatagtaaccaggcgcatagatggcgtcgatctttttatgtttcaacgcagttaggatggcattaaagtccttatcgccctcttggaacgtttggctgctaacgaccgtgccccgatactgcttcttaaacgcctttgttaggcccgtgccgtaatcactggagttatcagtcaaaatggcgacgcgtttcgccttcaagttcttagtcacaaaggttgctgccgtggctccttgaaaattattctgatagcaagctcggaatatgtacttttgaactttgccgctcttttgcaacgtataatccgggtcagtcgctgatggactgactgatggtactgccgccttagtcatattagggatcgccgcagtcccggcactagttgtcgcgggaccaactacggccacgaccttatcgttattcacgagctgggccgccacggaggcagctgtcgtattcgatgtcttattgtctctgatgaccaactgaattttcttcttggtccccccaaccttgattccaccgctcttattgattttcttgacggctaactgaataccttgcttttgctgttctccataaccggccgcagatccagacaattccatattgaccccaattttaatagtcttgccaggattatttccttgacttgaacttgatttggcagtggcacaccctgccagtgtcaacgccatcgcaccaagtgctgcaatcttcatcgtttgtttttcccattttttcattagttattcccactttcgtttttttattgctacgttgttgaccccgatcctccttaagtcacaaaaaggcctcatccaccgtagtgaatgaggcctttacccggaactgagcctcattaccacaatgggaaagaagggctcagttcacttgaattttgagttatactcaaggtcaagtgaccgggtccttcttcgttaataataaggctaaattttgaacagcaagggttgtcaacaagttggttaggttagattgaattttcataattgacgcgcctcgctttcaaaagtttttgtaatgttgatgtttcttagattaattaacttttaattataagtcaagcgtatttttaatcttttttatattaattaaaggcgaaccgctacgggcacatagtgtcgacagtgatttaaaaaattattttgggacctggccaactggctcattcagtcggattaaaagtataaaaaaagaactgattactaaactggcaatcagtcccattcaaaaattaagccgtcatggtcgttattctagttaagcctttaagagtttttcaacttcgctcttgagcttagcttcgtccatactcatataaggcgctacttcgtcagccgtcttgtcagtatcatgactatcggcgtccataaagtgattccaaatcgcatcccgtacgggtaacttagagtcgctccaatcaaacacgtccgtcatcttttcgtctaacatactgttcatttcaactgctgcagccatactaaaacaacttcctttctaatttttgatacaccttgattataggtcaaaatttgaaaagtggttaaattttgtttggtattacgaaaataaattacgcattcttttgataaattgtttgcagagccgcaatatcagcatctgataacgtgctcttgccttgcgagacagggtacatcactgattcagtcgacgaactgtggtccaaccctaatgcgtgacccaactcatggactgcgaccgatttactgaaagccgaggcgtatgccccgttaagactagccgtcgcgttattccaatattgggtcccccgccagctgatttgctttgtaatatcagggccaccgtggccaagctcaacgctggtcgcaccagtcgccatttttttatgatacatcgaaaaagtcactgaattctgtgatccgctggctttaccggccaccagatggaccaacccggtctgattataagtcgcaacagcttcaagaaagacctgccgggccgctttaggaacgttgcgatcaaaggaataataatacgtcttctttaaagtgacattctgcacgattgattcaatcggcgttgccttactagtggattgagttgtcgaactagttgcttgcgaactggaactagtggccgagctggcacccttatccgtctgctgtcctgatgattgcttgcttgagtccgcgatcgaatcttcagtcgcgctgctagtatcatctgcgcccaataagtgactggataagtcgcccgacaaggcagctgctaggttttgacgactcgtctgatatatcgccgccgcgcgcggggcaagcgtatcatagttgcgccacccaaatagcacgaggccaattagaaatagcgctttgattccgcgccttaaatttgttagcattccgtgcgctcctcctaattttctaacatagtgacaagcagtaatttaagtttattaaaccacacgacacctactttaaacatagctcttagtgaatcattaagaatatttaggattgccgcaacctacttgtaatcttaatccgctttcacacacctacccgccattctagcaaccgtagccaccccgcggagacaaaaaaagacgtgaattttcattcccgcctggatggtactatttattccttattccgaaaaacgtacaacttggagaacaagaagttcccgatgatggcgccggcctgcccaagaatcttggctagtaccgccgaacttcctaacattgacatcaacaaccacaaaataatcgcctcaacgacgtacgtcacgatccgggtcgcatagaacttgcccatttcacgataaacgtggtgtgaatggtggtcgaacaccttcaagcggtcaacccagaacgcaacttgcacggcaatgacccaggaaataacgttggcgacctggtattcgagcccaattaggtgatacgtcgtatagaaggttgcaaagttgaccgcaacactgatcaatccccacaagatatagcgaatcgcttggttacgagtttctttaacgggagaaatgatttttttatccaattccgccgctggttctaaaatttcagtaaccgtttcctcattttgatcaactttaatcgaatctggtttactcatggttaccacacctgactttcttcacttaaacatgattattgtgaaataattcggtttaagtcgtatcttcatttctatgagtaaaaataacacaacttaatcttagcacagcagttaactgttggcgatgacaactattcagatttggaccaataattcacatccatgaatcatcaacctatctcaactaaaatatcacggtcagtttttagtcacccagcaactcgttggcagtcatcttacgtcggcaagcgttgcagctaccattactgaaaatcgtctgtcgtgaaacgtgcaattgcgtcgcgatgtcagtttgcgtcatcttcttttgtcgccgaataatttttaaattatctgaaaagctcatttttacacctccaaacatatcgtacgcgacgggtgattgttcgacaagcgacgtttctaagcaaggcgatgaagccggtgacttgagcgtgttgtgctttttgaaagtcgtcattttttacgaacccaaacgctattctaattatttttatcatagcgttttagcctactttcgtgattatttagtaagttaagaatattattatcaacagggatatttaaaatcaaatgcttttaaatattttgtaggtgtgcctaaaaaagtatttccatttacttttatttattgtacaatgacaacggctcaaagatttagagatatagaaaggtggtcttttaattgagcaaaaagacgaacaccccaaaccggaagcataaattgattgaatatgctaacggcccctcactagaggaaattaacggtaccatcgaggttcccaagaatctgaacttctggaaaaccctctttgcgtattcaggtcctggtgccttagttgcggtaggctacatggatcccggtaactggtcaacttccatcaccggtggtcaaaactaccaatacatgctgatgtctgtcatcttgatatcaagtttgattgcgatgctactacaatacatggcggctaaacttggtatcgtgagtcagatggatctggcccaagcgattcgggcacggacgagtaaatcactcggaatcgtcttgtggattttaaccgaattagccattatggcgaccgacattgccgaagttatcggtgctgcgattgccctctatttattattcaacattccgttagtcattgcggtatttattaccgtgcttgacgttttagttctgctattattgaccaaaatcggttttcggaaaatcgaagccatcgtggtttgtttgattttagttatcttattcgtattcgtttatcaagtcgcactgtccaaccctgattggggcggtgtgatcaaggggttagtcccaactgctgacactttctcgacaagtcgttcagtaaacggtatgacgccactttctggtgctttagggattatcggtgccaccgtcatgccacataatttgtacttacattcggccatctcacaaacgcggaagattgaccacaacgatgaggaagatgtcgcgcggaccgttaaattcgccgcttgggattccaatatccaactttcatttgctttcgtggttaattcactattattgattatgggcgttgccgtctttaagagtggtgctgttaaagatccttcattcttcggtctttatgaagcattgtccaatacatcaatgttaagtaatggtattttaatcagtgttgctaaatctggggcgctctcagccctcttcgccatcgcgttactggcttctgggcaaaactccaccattaccggtacgttaactgggcaagtcatcatggaagggttcgtccacatgcggatgccactctggttacggcggttagtgacccgcttgatctccgttattcccgtcctcatttgcgtgctattaactagtggtaagagtgccatcgaagagcatactgcattgaataatctgatgaataactcacaagtctttctggctttcgccctgccattctccatgttgccactattaatgatgactgacagcgcggcagaaatgggcaaacgattcaaaaactcactttggatcaaaggcttaggttggttatccgtcatcggtttaactttcttaaacttactcggcctaccagattcaatcttaggcttcttcggcgataatccttcagctggcgaacagactttttctaaaattctcgcctacctcttaattgccgctatcttagccctccttgtctggaccgtcttcgacctacaacgcggtaacaaacgttacgttgaacagcaacttgctgcagcagcaaaggaggccaacaaataatggcgactaaattcaaccggattctcgttggtgttgatgattctgccgatgccctacttgcttttgactatgcaatccatcaagcaaagcaggatgacgccgaattgatcattgtctccattcttgaagatgatgacatgaacgtttatcaggcactcagcaaggactacattcatggtgaacgtcaagaacttgaacagcatattttgaaatatcaaaagcaagcccaagctgctggtgtcactaaagtccacgcaatgattgcggaaggcgaacctggcgagaccattgttaaggaagtcatcccccacgttcaaccggacttactcattattggctccctagccaaaaaggggattgccaaacactttggtagccaagctgcttatatggcaaaatacgcaccgatttcagttttagttattcgttaaatcaattaaaacaacctcaaaacccccgttttcaacgtgaaaacggggtttttaggtttatcaaacattatttgactattaacctaaacatactataatagtcactgaagggggattcgattatgacaccaaacgaaacctacgacgcattagaacaatggcacttattaccggcgactaattttacctggcggcccttcactgctaccgctatttatgttgacagcccgcatgcgcggcgtgtctatcagctagacttagccgacgacacggtcgaaatctttcaggcggatccaggttcagagctgtctgagcatttcttaccatataagacagtcacactgaccacaactcaaatcaatcaattcaagcatacccaaccggttgcatcataacggctacgggcaaagcggcgggcacaccctcttagtcaatgattaagaaggcgcgcccgccgcttataatttcaattattaatgatccatatcaactgctcgttgacgatcatggtgaatcaaccacaacaaccccaataagagcaccaagagtccaaccaacatcagcgcattcttgaagtgcgctttaatcagttcatcgccaccccaagcataaataatcgccgtgggcatgctgcccagtagcgttgctgcagccagctgccggggtgtcaccgccgtttcaatggccgctaaactaactaatgacgttggaataaacggtatcgtatacccaatcacgattcctaataagggatgccgcatcttaccaatggccgtcacgagttttgacggctgttgatcccgtcgcgccgttacccgtccgaaaaagcgttgtgcaatcaagttgcccagggtgataccgacaatatttaacattgcccccagccccttgccgaagcagatgccagcaacgacactgatcgtcgccacgggggcacccggaataatcgaaaaacaaattagtaagggaaccactaataaaatatcaaccgcacggtgccgccggacttgggccaccagtgctgattggtcaaacacccggtgctgaatgagctcccaagtaccgtggtagcgatagatcaacagcccaattaatagcaatgccagtagcactgccccaccaatcagttgtcgtttcgttatcttaaccttcacaacttcctcccgtcattaatcacgatgcggttcatgcttgatttcatgcgccacatgtccaatcatagcatcgaccatgtccaaaatatggggatcgtctaaacaatagtagacatgttttccccgcttcgttttagataccaattggtactgaaacaaaatcgctaactgatgcgagactaatggctgcgctaaatgaacatgttcaacgatttgcgtaacgtccgcttcatggtgttctaaaaaaattaggattttaatccgattaacattactcagtactttgtatattttagccgcctcagttaatagtggcccgctgacctccatgccaattcctccgttctcaccaatcataggaatgcgattaaatggctaattagcccactatcccagaaaacatataagccaatcaccacgtaacaaattttcatcaaccgttcaccatgagccgctatttgcttttgaacagccttgatttccgccacctggttaatgataagcacgacaagcatcgtcagtataccaataaatcctaaagtcatcacaaagtgtaccatgctttccccaacgagcacaggtaaaaagatcgataaattacaaccagcacatacggccaaataagtgactagtacgttaatcaccggcgacccaccagcccgatcggcggtatcatcatcatcgtgaaatgcaagccaaatcggcagcacacccaagaatcctaataaccattctggcaaaaataaggtcagtgctttacccacaaagaagcttgccgttagtaagataatattgcccaacaaatagcccaataagacctgccacaaccgatacttcttcaataaaaaaactaacatcaagcaaaaatccaaattaacactcaaaaacgtcaacgcccaaaccccataatgcatcatctcacccactcttccttacgcgtttgctagtattaagcatcaattgtgattaaaacgtgccaagtttagattcctgttcgtcagccggtgatcgtcctattccgacctccggggctgggtgacaattgctggaacgtaagtcgacgtcgatttgagctaacgcataacccgcgtcatctcaaatacgagtcttattctaagccggaagcaacccacttccgactaagaataatttggctactgagcattgtcacccagcccctccggtcggtaagccgctcgaatggctgatgaacggccacttagcttggtgcaataggtcgttggctattttgataaggggactttgagcgaaatgtcagatgcctgacctactttttcgtaacgttcaattttgactacagcagcttaggagaatgaactattccaatatcactttcagtctgacagtttcttagcaaaattaccgtttatgaataataacgaccaattcatcaaaagttgggtacatctgcgtctgccattcgaataccatcccgactagaaggcgtttctgacaatgcccagtggtgaaatttcacttagcaagcgtcttgtgcttggttagtgaaaggccagtatttaagacgtgggcttcggcttaaatctgtgcccaccacgttccggcaattggcagaaatgcctggagatcggtgtaggacgcgcaccttaagcaagtttacgctaactcgcaccagtttccagcgggcctaagctggctgcctttgaacttaaataatcacgattcatgacaaattggctcgcgcaatgtgtgttctatttagttgtcttcattatatgtcaatttcgacatatgtgaagtaaattagcatcaaaggccccacgtacaaaaaacggtaatgaaacccgttctgggcttcattaccgttttactaacagactattttagttgatgactcacaattacttaatccgcggcgagggcgtcgattggattcaaccgagcggcacgccaggctggtaggatggctgctaataaggcaatcaccagggcaatgataaaggtcgagataatattacttacctgaatctcaatcatattgtagctggcgatttggtagaggactttattcaaggcagcaccaataccataggcgattccagaagctaatagtgcgctgatgactccgatgatcaatgattcactcgtgaacaatcgccgaatatcacggcgactttcacccagcgcacgtaagattccgatttctttcttccgggcactgaccgacatgaacatggtcacaatgatcattaacgctgagactagtagggaaattccagcgattgccgccaaaatcgtggttgctaagttaacatacgtattgaccgtatcaagcatgctggcaatgctggtggcacggtaaacccgtttgccatcaatctttagcttattaatctgcttggttacagcatcattatgcttccgcgaatcaactttcaccgcaactgaagttggctgcgtacttaaattctttgctgaccgcatatctttcatagtggcgtaggtcacggcgttcacaccacttccagtcgtgctgtccgtaatcccagcaaccgttaattgccatttaaccgtgacacttttaccactcttattcgttgtctgaaaagccacagtcactttcttaccgaccaattgcttccaattcttagatgaccatttcttcgccacactactcttatcgacgacgatttcattcttaccagccacgtgaccagctttaataatcgacttccggttagaagccgtccacgttgttaacgatgaagcggtgtagtctttattaccaactgtaattgtcgcgttgcttgcactcaaaattggctgaacggtctgaacatgcgcaacttttttcagtttactcagttgggccgtactgaacgttggctgattggtcgtcgtcacactcgctcccatggcagctgcctgctggttgccttcttggctgccgcctcgctgactttgactcgatttttgataccgactcactgtcacgacacggggattgaccatatcattgatttcctgattaatataccccttgaggccattacctaacccgttaaacaacatcactgcgaataaaccaatcgccgtcccaatgataataatcaagttccaagtccaagtatagcgtagatgtttaaacgccgtgttcagtggcacataccacggtaacttacgtgccgcaatctgttggcgattttcatcgaccggataagcgggtttcacccgctcgtcatccgtgattttaccatcagctaagcgcacgattcgagtacccgcattcgcaacatcctgcgaatgcgtcacacaaatcacaagccgaccttccgccgcaatctgatccaaaattttcaaaacttccgtggtattctcagaatccaatgcgccagtcggttcatccgcgataataatctgcggatcactcgctaaagcccgggcaatcgcaactcgctgcttctggccaccagataattggttcgggtactttttaatttgatccgctaaccccacctgagttaacagttgcttagctcgttgctcacgttctgaccgatttaacttggtcatatctaacgaaatcaggacattgtctaacacggacagatggttgatcaaattatatgattgataaatataaccgactgtttcacgccgatactgatccatctgtttctcttggtgatgatctaacgcggttccttgcaataacacttgtccctgaaattgccgatccaagccaccaatgatattcatcaacgttgacttaccaccgccagattcccctaaaatcgcaacgaattcacctcgttcaaaagttagattaatcccattcaagactgggaaagcttccttgcctaaataatagaccttgtgaatatcttttaattctaagtagctcatcctcgctcaccctaccttactgtacgtcaatatcgtatgccaactcccctttatttatatcaagggctttaactgtgactattagtcattaagtttaccaaaaaaacaactgtggaaaaaatcttataccttatttttattgaatcttatcatagctctttagttagactgtaacaacaaaaactaactattaggctaaataatttgaaattaattattagggagtgacactacaacctggttcgctctggtacttcaactgacgtcaccaccgttgatcagcgtgcacaaaaggcagtttcgagaaacacaccgttcccagaaactgcctcatccgtgcttacttccaaaattatcgtgacaagttatatttacctaggcgcgtcgcttccgccaccaaaccgcgattgcaccagtcagcatgaggaacacaccgccggcgactgctagccagcgttgcaccgcttcacctgtctgtggtaaccagccgctaccatgatgacctgtcgaatgactgccatgattagtagttgcactcgagctagtttcaggcaataccgtgccactcgtcacccgatccgtgactgtacttgcatgcgaactagctgtaccgaccgtcattgaagtgccattgtcgttggtgctcgttttgtctgcacctgatgtattaactgtcccgctccccgtggtgctagtttcatgcttgtcgggtttgacagcagtcccgttgccattcggtttagtcgtgctactaccatttttgtccggcttaacggtagtaccattgccacctggtttagtcgtgctactaccattttcatccggcttgaccgcagtaccgttaccatctggtttagtcgtcgtgctaccattttcatccggcttgaccgcagtaccgttaccatctggtttagtcgtcgtgctaccattttcatccggcttgaccgtagtaccgttaccatctggtttagtcgtcgtgctgccattttcatccggcttgaccgcagtaccattgccatctggtttagtcgtcgtgctgccgttttcgtcgggtttagccgtacttgtcagcggattatcattatccaaatccacaagcacttctgtaccgtcggcagtggcggccatcgcttgactcaacacgatggtcttagccgcccgcgtcttacttgggacaagtttaatcgtcaccaggtcagtcacgggttggctagcactaaccgtcaatcttagttgaccattagcgaccgtctgccgtaaaatctgcacgccggtcggagccttgacgtcggcgacttcccgacctgctaagtcaaattgcagatcaaatgccgtcagttgccggttttggttatgagtcaattgaacttgtgcttcttggtcattgcgactgagctttagcgtttcaactgaacgtttcttcttcgctagatcagtctgcttaagaaaagctgatgaatcaaagacctgactgtcaaacatctgtggtgtttgtggcacttgcaacgcattcaagatgagcgcactgatatcagcgttgctaccaccatgcaaacggcggccattatcgactgtttcgccaccgagcgccatgaaaatactacggttatattcatcccaaccaccatgattcttgccagaaccgccatgatcagcgttggcaatgactaacgtatcatgaatgtgaccggttgcttcaagcttatccattactcgcttgaacagggcatcatattgggcgtatttatcccagtaattgtcattataccagccgtgaccgtggccctgaccgtccatataatcactttgcatgtagactaacccagtattttgaaattccggcgtaccgatatagttagccacatcatcaaaggatttcagtgaagctgactgtttagtcgtcaccgcggcatctggttcgatgatgctattgacgattgggccccattctgagaaagccgcagcgcactttaacagtcatgaatagggataaacagttcatttgcatctataggatcatctaaagtcaatcccattcctgtttttggaatattagattgaaaggcttatatggccgggacctgcttctctttgcgctgtttgtacttctcctgagccttcgaaggtgaataggatttaccagtagaattacggcttaattctcgagaaatggttgagtaacttttcttgatatggctggcaatctcaagaagtgagtttccatgattcctcattaaaaagatagtttcccgttcatctatggtaatatgcttgtagtggtccatggctgaattcctttcatgattgttttcgcaaacatcattttacagaaatttggccatgggccattctttatttaattagtgttgcacttaaagtgtaaattcaaggttaatattttcattatatgcaaaaggattggtcaccacaatgaccaatccttaatgtttattacttttaattaaatgctactattatcatcattattaccgagcggaaacgtacgccaaaaggcaacttcctgccacgtaaccgcctttcgtcccactctttaatgtttgttacttttaattagatgttgctattatcatctttatcaatttaaattgttggcaacttgtttatgcttcctgcagtaatcctctggggttaaataaaccgagtgatcacctaatgcactcgttatcgtcataattcttggtggcagcaatcccacccgcttaaccagtcctgaattaccaaataaggctgaaggtgtcccggaaaaggcaatctgaccatgcgccatcacgtgaactgtcgaaaattcagccgctacccaatccatatcatgagtaatcgtgatcacctgatgaccactttttacaagttgatgaaaaatgttagtcattcgctttcgactgggccagtctaacgacatcatcggctcgtcaaacaaataaattgcaggattaatggccaaaaccgttgcaaacgttaataactttcgttcagataacgaaaggtcatatggattttcggctgctttatcagctaatccaaccgcaaccaaagcttgatcagccgcttttttaatcatcaattgatccgattcaatttgagaaagcccccaagccacttctttttgaaccgttgcgttaaataattgatcatctggatcttgaaatgtcacgccaatttgtttcaactttgcctgtggtttcaactcatctattgaaacgccattaatcataatggccccttcttgcggtgttatcaatccgatcagtaactttaacaaagttgatttaccagcgccgttctgaccaacaattgcggttagtggactgtcaaaagattgccgatcaaattccacctgaaatgagtgttctggataagtgtaacgcaacccactaatttcaatttgcggcataataagcctcctttaattgttgattggtaaccggaaatttgtctgctgcaccagggattgaccacttcattaattttgccaatcgaaacacagtcggttcagcaagctgccagtccggcttcagatgattaaaaacagtcagcggttttcctgccgcaactaactcgccagctttcagaacccaaatttggtcagcaatttcacagagatcgtcgacttcatttgacacaatgaagatcgtctttttttcaacactgactaaccaactgaagaaatgctgacgtccaagtggatccatttcactggtgggatcatctaaaaccaaaattgacggatcagttacgattgctgtggcaattgccagccgttgtttttgtccgccagacagcgttcccggtgattgatttaattggtcgcctaaccccaactgatcggcaacattgaggactcgccgtttaattttatcggctggaactccttgattaatgaggtcaaacgcaatttcatcggcaaccgtatcggcaagcccactcaattgaccagccggattctgcagcacaacaccggtttgctgattatacttctgccaatccaaatttggcgataatgatccaacttgaatggttcccgttacatcacctgaaataattgttggtacaattccggctaatgcccgacataaagatgttttacctgcatgatgattaccaatgatgccaataacgtgcccaaattcggcgtcaaccgaaatatgttttagcgcggatgtttcaatccctcggtaacgtagacttaaattttctaaatgaatttgctgccgattatccataatttccacccaatcaatataattgctaataaactcaagccacgatgattaaccatttcgtgccgataaagatttgccgattttagttccacccgatggggactattaaatccacgtaatcgcagggcgatcgaccgttccattgattgatcaagcgttttgatcactaacggaaccagcactggtaaaattgatttaatcttttcaagaatggttttctgttgattaatgccacgtgcccgttgcgccatttgaatttttttcatgttggccatcatttccggtaaaatatagcaaaccgacatcaatacatagaccgctttataggagagaccgacctgctccaaatatttagaattttctgacactgtagtcgttgtcataaaaaagctggttgctaaaataatgacaaaaattcgacaccccatcgttgctgcatacaacagcccttcttgatagaatcgaatcccgaccactgaaaccaacagagtctgattgtgactgtaaaagaggccctgaataatcagcattgtaaaaattaagaatgagctgaattcaattgcgtgaaccgccgacttgccggctttcgaaatcagtagaatcactagcgcaacgaatacaagcgcaatttcaactaacaaattggtgaaacaaaagcttagtaaggccagatcaagggccatcaataatttcgttaccggatcaactaccgacgtccagccacggtgagctaccgaaccttgtaaaattgaatttggttcattcattatttatcatccctgaaaaagcgaatcattcgctgtggcagttgccgatagataaagaatgccaagtaggcaacaacaactttatccaaaatgtccaaaataaattcatcagtaaatgatgaaatccaaaccggaatgtgattagcgatcatcgcagcgaaaattgaatcaccccaaggaatcccagtttggccaccccaaaaaatgacattgagtggtgttgaaacgacagcagatacaattgcaataataatagcggatacgaatactttctttgcggatgaaaaccatcccttggcgtggaggaccccaacggcaatcccaattccaatactagtaattgcgtagaccgttgaaaccggtgacagcgtcaatccataaatgacgttattaataaagccactaattgcaccagccaccgggccagctaacatacttgccagaaaagttcccaacgttcctaaccaaaccggtaattttaatccttcggcaaacgccttggcaacataattaattccgactgctgcaggaatcaacgtcatcgttgctgttgacaaccgaatcttccagatacttgaccgcttaatattttggacactcaaaatccgcacctcatttgcttaattattttaattaaaggtataaatcacttttgtttaaaagtaatttatacctttaatctaattaaaaacattgtacgactgttttgataaaagtcaagtcaactttaatagtttttgcagttgtgacttggtcttttttcttcttgaagcttatgttttgtttaatacggaatattttggagtaagctggctaccgagtctaaacgtgcaaagagaagcaggtcccggccatataagcctttcaatctaatattccaaaaacaggaatgggattgactttagatgatcctatagattcaaatgaactgtttatccctattcatgacttaaggaagtatgttaaagtacacaaatctcaagatattaataatttaagattaggagatatataagctcttggggtatatttttactaatttttcatgaaagaaaattgaacaaatttgtatagcaattctcttataagtaaggccaatagggtatatcctagtggtcttacttgtctgcacgagctgcttcaatttgcaagagttcaatagcattgtccaaaattatcaatcaactagcaaacagaggaccttaagcaaaactactgaacattgcttaaggccctctgtttgctacgtattatctaagtttatgcattgtttctgccataatccaatgaatgaattttaaattactgataaagaatataaacattatgactacaacgataatccattcccatagcggagcttttgttaatgtgactaagctgtataagtaaaaaattgttatgggtaattcaataattgcggttatagctccaggaacataagcacgtttattaaagacaaaaactaagtgcatgatcaaatgaaacagatacggtaaaattgcagtggcaactagtaatggtgagcccatgatataggcgactgctgcgagcagtaaataaatacaaaattcttcccagattccagccgctaaaatatctgaacgattcactccaccaaacagcacacgcccgttaattttgggattatgatctttcaaccaatatgggacaaatactaactcttcaaaatcatggaacataaataacaatggcaatatccaataagaactaaaattaatcattttatggccctcccgctagtattatattatgttgatgcgaatctttgaatataatggaaacatgtgccactgaaaggagtttttgtgccatgtctcggacaatgattattgaagagtctaaaaatgcttttattgaggccttgtttcaactactgaaaagcgaatcctttgaacatattacagtcaaacagttgacattagaatcgggttattccaaaaggacttattatcgatacttcaaaactaaaacaaaaattttagatatagcattttttaaatatctcactagctatcatgattacttactaaaatcttccattacaccggatactatccctaaacattttcttgaatttatttggccccaccatgacaaaattgaattgctagctaaaaatgatctcttagttcctttgctaacaagacatattcaaaccattgtagcgcttctcctgaatgtaaatgtcccttggcgaaaaggcagtttgaataaccagcattatgagtacatgctaacgtactcaattggtgggttcggtgttctactggatacgctttttaagaagagtgctcccttatctccagatcaaattagcaaagctttaagcatggcattgaaagagattgctatccaagttgatatgaaataatataaaaaataccatacgttcaggatttctaactgacatttagcctctataactatatggtagattgtaaaattaatccgaacagcgtcggattaattttacaatctaccaattgcatgagtacaaaaggttggtagcaattaaaaaatgttcgataaataaggcggagtagcccgttaaggactactttttttggctataataatcatatactgcaaacaggaggtggcttgtattgactaaaaggaagttatcagtcccagaaatcacgacagaactaggggctcactgacaacgtgtgtatcgctcgataaaaggttgaggaatgtcaattactacggcgagcctactatcaagctggatagagagcattttattgtggtaggcatgtcgcggagatacaggtgccaaaaacgcgagtgagatagaaaaaaggtgtaaatgcttgatataaagccaaagcaagtcgatacaaagaagcgcatgtcagtacaaatgatacaggagaaaactgacaaagccttacagataaagagtttaagcaaggtagtgttgcagtacaaaaagtactggcggccaagggtcaacaaataaactagcacaacggggacttgaattttaattttttagggatacaataaaattatattgataagaggtgaatttaaatgaacaaatatgtcgaacttgatttagaacaattgcaacaaatctcaggcggtatgagtaaaaagcaatggtatcgtttaggagaacgtgtcggtcgtgtagcagtttttatcggtggaggattactttttaaataaaaatttttgcgtttctatactggtatgtgttatcgagaggtcggattctttatgaaaaaattaaaatcatttgaggtgctttctgatgaggaggctaaattgataattggcggcggacattgctatacggcggggtgtattcggcgtagagataagcctcggaattcagatagcttttttccgggattagcacatggtatttgtcaaggagttggtatttgcggatgaaacccctttcttataaaaaaccatcgttttatgtgtttattttattttcactgttcttaggtatttcattggtatatcggagagattggtggattacaatccctcttgtactagtagttttaatacaaggatatagaacaattagataatcataaatataagttgctcttggttggatgtaagctgattcctgagacaacttttaagagagggtataatgaataaatcatctctcaaaaggaaggaatttttacatgccaactcgttacgacaaagaattcaaacaaaacattatcaacctatataagcaaggcgaatcagctgcccaactggccagagaatatggcattggctaatcaaccgttcataagtggatccagggccaggccaaaactcaatccggtaaatcgccagacgaaatcaaagcgatggaaaagcgactggcctcgctgtctgaggagaacgaaatcctaaaaaaagccctgggcttctttgcgcagaagtaaccaatatctttgattacattcaccaagaaagccatcaccaccaggtaaccaagatgtgccgaatcctcggtgtttccagagctcagtattatcgttatcgatcccccaaaccttcaaaacgccgggccgaagatgcggacttgaaacaacgaattctgcggatctttgcggaatttaagcagcgatacggtgttatgaagatccaccatgaattgaatctggaacttcaaccactgcagcttcggtgcagtccacgacggatttcccggctcatgaagaaactggatatccactccgttaccgtcaataagtggaaagcggcttcggcttccaaaaccaaggttgaacagcgtcccaacttgcttaagcaggatttctcgaccactggtttaaatcaaaaatggaccgctgatatgacctatattcaaacgaagcgtaatgctggtgttacttatcaaccatcatggacctgcactcacgacggattatcggctattcgttctcaaaaaagatggctactgatttagtcttaaagacccttgaaagcgcggttaaaaattgaaccattactggggacctgattatccatacggatttaggatcacagtataccagcgatgattacaatcaacgtttaactgagctacatatccgccactcatacagctgtaagggttgtccgtatgataatgcgccaatggaatcctttcacgcttccctcaaaaaggaatgtgtttatccagtgccggtctttgaagattatgaaactgccgctgccgtcctttttgaatatgtgcatgctttctacaataggaagagaattcatagttcactgggctaccagacccccttacaagttgaaattgcaacacttacgagccaaatggccgcctgatttaatgctttccagggttcaaataagttattaatcgcgattaatgatttatttgagctgcggaaggtaaacgcggttctgaatgtctcttaaaagctgtctcaaatattgacttcaatccatatctcttgaaaatcactacaatatcattgggctttttttaacacttttcatttttaggttagtcaaaacatattttatggttcatctcaaacaatgtgttatacttaatttgtatagaaaggaagcagtaaaatgactgaaaagcacttagaacttagagattatggcccacaaccatttgctccagatttaaaggccgctgccttagctaatgacaattatcgaactactttgtggacgggtgatcattttcaagtcactttgatggcaattccagctggtggtggagatatcggaatggagattcaccatggtaatgaccagttcatttatttggtagacggtgttggtcacgttcaaatgggcaaagataaaaataaattgacgattgaccgtgagattcatcctggtgaagcagtaattattccagataatacttggcacaatgtaattaacgctggtagtaaaacgatgaaggtcttctcaatttattctccagtaaaacacgccaagggaactgatgaaaagaccaaagatgatgcgattcagcaagaaggcccactagagggcactggtgaataaagtcatgagattttttttgacgatgctaatttagcttctcttaacctgatttattcacaaagatatgcaaaatacccatcaaacacatgcatcacgcgtttgatgggtattttgcattttcaccttttaagtgcacaaaaagagtctcagctctggtatagttaaattggcaaacaaaaccacatgagagaagaggactctacattgaagactttacaggaaatggcgttcaatttcaacaaaaacattttagtatcgcatacgggtggtcaattatcttccgatggcgggctgacattgtgtgtagaactgatggaaaagtttcagttcaccaacttggccgacaagctattgaggctcaatgaccagcggagatattgtcaactttttaaagcagctggcactgacaaaacatgattccggcttgtgcgttagcacattgcggatccgtttattcaaagttgcggcacgtgttgtgcatacgggccgacgcattcagttgcggctgagctcgcatcatgtttaccatcggctgttctaccaggctctacagcgtatccaggctattgaataaccggcaaaattaaaaaaatctgtacaaccaagggacaagtgtatccaaaagttcaaagcaattctgagttagttgaaagatctcactagctagaactgataaacatcgtatttcagcaaaagataaagacatacccgtcatttttcgtgttttttcgaaaactgacgggatttttatgaactatgaataattcaggttaaagtacacaaatctcaagatattaataatttaagattgggagatgtataagctcttggggtatatttttactaatttttcatgaaagaaaattgaacaaatttgtatagcaattcccttataagcaaggccaatagggcataccctattggctttacttggctgtatgaactgatgccacctgcaatagttcagtaggattgtccaaattaggcgatatttatcaaacagtatgcaagctaatttcgtgtttgaagatggtaaaggtttgatatacatgctgctgtcaccacacagagggcaccagccccgaatagccagattcagttccaggtctgccggatccaagacgacgagcagggttgttgcaataattaccacgaaagaaggttgccaagtttttgacaagcatcaacgtgcaataaggacggtaagctaaccgtaacgccaaaagctgataaaaccgcggagtatgctggtaacccagcaaaaccaacgactccagtacctaagtcaacggttactaaagtagttaagatggcccaaactggtcatcaccaaacttggtttgatcgattggtggcttggttcaaataattgctagtttgagggctcagcacgtatactaatggtgttaagaaatgactactggccaataatgggaggaatcaacatggctgataatgtgttaatggcctatcatattgtgcatgatcctgatgagcgggcaaaacatgttttgaatacgaaaaagttgtataagtggcggattaccgaaaagacgaagggcaccccggtagttggtaatgtggcattagtccaaacccagtttgcgaagcgcaccccagttatgatttatgcgacgaaggaagttgccaatgatttgagtgacttacaaccagttaaagtctttaccaacaatcgtgatcaagagacggttaatcaaacgtttgatgacctgatgagataatctaacggcttgtaccaacatgatttttttcaagttggtacaagcctttttttataatttaatacttagtaaaatagtgcattttaatatatctgggtggtcattaacaagtgcattgtgtaaataatttgcttaatgattttaactacaaaaagccaaagagatttggctctctttggctttttgtagttaatgcagacttgaatcccacttagcattttaagagaagcacgtggtaatttaaaaccgatgattttgttcaatcaaatcattaaaatattttgaatattgattgttttcaatccagaaaacaaggaacaaaagaactgttacagaaattatggatcttaatatctaggattgaattgaagcatgctgtgcatgtaaatactaaaataatatcttctgatgtacgatgtaactaagcatcatattgaaataattttattttaattgcatgagataattccttgagatctgacgaaaatatcttactgttaggaaacttcacgtacttagctttgtttaaaaaagaggcgggtaaaacatgatacacgttatctgggaaaatatatatagtatttggatttggctcccaatttgactcgaattctgatagagtaaaaatttttgagatgttcggaactccttgcaacgacttttttaaccggtgagtaaaatgtgctgagattgctgagtctattatcatactgcctgatatactactttcttgaataccaacgacagcagaaggaataatacaaatattagtaaccattttgttacctcttttcttaaatacatgataccacgaaagcaggaatgagaatgaaaaatagacaaaatgaaattgacagttatttgaaccttcatttaaggcctgtccataaatcatttgattttggaaatttaacaaacattgatcaatttagacatcatatttatgtatcatatattgtaatatgtaaaaattctcaagcaactattgaaagatgtgtgaattcaattgctcaaaatatggaaaatggagatgaattgattgttttagacactggttcaactgatgaaactgtgcatctggttaaaaagaatatgccacaagcaaaaatatcagtaacaaattggaaaaatgatttctcagaggttagaaataaggcactcaaattagcatctaaagactgggtgttctatgttgatagtgatgagtggttggatgttgatgatggagctcagctaaagaaaattttatttaaagttcaagcaaaaaattttaagttcgtaattaacccaacattttctgatcattcaggacagatataccaaacagtagggagaatcttccctaaaaagtcgtcctttcattattatgcaaaaattcacgaagaagtaagaaaagaagatcaaaaactaggttacgatgttaggcacttcgcatgtgatgatattattctttatcatgatggatatgataaagaagtattacgagataaagataaaataaagagaaacattcgtttattacaagagatgacttgtgaggagcctcaaaatgctagatggccgtttttactagcacgtgatggatttgatgtactgcctcaggacaaactcaaacagttagtaaaaaggaccttagacttagttgcttccgacagtcttcaagaaaaatattcgccatttgcaaaaaaattgcttggccgtattttattaagagaaggtaaaaccactcaagcagtattatcttttaaagatgttttacagataacaggtgggaaagacagtgatgcaatatactatattgaatcatttaaaattaatgaaattatagcggaagctaagtctatagaagtaaaaatgttgagatatttaaataaacacaaaggaatgattgatgttaatagcgatatatctggaaactactatcatatagctcaggttattttagaatgtgacataataagtgccaactacagccatcttttccctttaatatcagaaattcctaaaaacttttcaggcgatataaaaagtagtgtcaaatctgcagtgaaactgtattcaaaattacaaggtgacagcaaaaatgagaataattaaacaaattgaccaaaatgattgtggaccagcagcagtagcaacaatcattggtatgattagtaaaattaaaattgatgactggcagataaggcaaattatcacaacaacaaattatgggactaattttatcagtataataaacggattaaagtcagttcaggttgagtctgttgtagaaaagtgtgtaaagaatccagatgtgtttgatgaaattgaatttccagtgctgacacaaattatgcaaaatggctatttacactttgtagttctcacgaagtgttctggttcaaaattatattgggcagacccaggtagtggaaaaatagaaagtattgacaaggctaaatttatgatgcattggacgccgcttatcttaacgatacctagatcacaaaattttcaaattctaaaaacaaaagttgaaagcttaaaagtccctattttgtggtttagttttaggaaacactgggcatgcctgttaatatattggatgctttcaataattatatttgctacaacactattcttagcaactatgtattctgcctattttaaccgcattgttcccaataagtttatttcagcgattcctactataactctcgtatatttgactgttcaagtagcatcaatttttttggaagttattaatgcaatccttattgcctatactggtaattcaatcagtaaagaattatatgaagacatctttaaggcttttcccaaaaagaagcggttagtagtagattcatttgaagatggtgaaattattacaagatttaatgcgatttatcaaattgcaggtagacaacttgtgcttttaggtgacttaccaattgacattattactatggggataaccctttttcttcttgctagaatcaatccatttttgacgattttattgtttattccaatgatattaatggcattattattttatctaagttcagacgcaattaaaaaaagaagtacaaatttgtttaaatcacaggaaacatttagccaagatattattgaacaaataaaaaatttttcaactataaaaacttttcatgctggtagctacatcaattccaaaataacaaaaagtatggaaaagtatactgcagcaaaccgtagttttggcttatatgatagattacagcagatagcaagaaatggtgtttcacaactgtttggaattattttattctcggtgggggcttttctagtaataaagggcaatattgtgcttggaacattgcttagtttttatgctttaacgggaaatgttctaaatccgtttgtgaaaataataactatgcaagtaaatctgtctcaaggaaaagtagcaacagaacgctacttagatctattactttctcctgaagacaataacaataaaagcaaactaacactttcaaattctattgaaataagaaaggtagcattttcatatgatggggttacaccaataattaaaaacatgaacggtgttttctcaaagtttccaactgcaataattggcaatagtgggagtggcaagtcaactattgctaaactaatggcaggtttttatcctgcagagggtctatcattaggaaacataccttattatgcaataggggcagaatctttaggtaatacaattacctatgttgaacaatcaccacaaatattttcggatacagttatgaataatataactcttggtaggaaaaatatcacagttaaatcaattaataggattgctagtagtattggttttgacgaatgtttgaatcatttaccaaacggaatatatacacaattaggatcctctggatattcattatctggaggtcaaaaacaattattaaatattataaggtctatggtaattccaagtaggtttatcatttttgatgaaataacgaatgggctggacatcaatacaaaattgaaagtagaaaattatttattatcacaaaacaaacctaaattaatatttattactcacgatttaacattggctataagatgtgatgatattttcactgttaaaaatggtgagatgcaccaaatagaaactaacaaaaactctactgaatcattgagggaggcattgttatgaaaaaaaccattatcactattattgcgcttagtgttatctcaataataggagtatattcttggcaaaggctcactttggtacaagagccattatatcactcaataaaggcgacacaattgcaagcagacataaaaaataagaaggatgatgtagtttacttctaccaaaagggttgtgaaggatgtgaacatagtactcccatattgaaccgctttattcgaaataaacgtgtcactgtaaaagcaatcgatataaatgcagatccaagcaaagattttattttgggaacattgggaatatcatcaacaccaaccatattgtttatacaccatggaaaaattgttcaaaggataaatcaagtctttggatatgaggacttaacaactaaatataaggggtacacgggagatctttagatgaatctattaaaaaaaagaaaactagtattaattttgctaatacttctcattattttattagtaattggattattttcggtgattattacgaaacggaattcttatgaacatgagaacgtacttcgggctgaaattatttcagaatcaaagacaaacactatggtttacaaggaattaaattcaataacaattccaacttttgaaaaggaaatttcggataaaagagattttctagtatatattggacggcctacttgttcagattgtaatttatttgatcctattttagttaatgaattgaaaaaagaagatatgaccagcaatgttgtctttctcaacgtagcatgggaacgccaaaagggatggacttcatgggtacagtttaagaaaaaatatggattcaagcagacacctgcaataattcactatcacaatggcaaagtattaagtattatacagtgggggaataataaagggataagtaagggagatttacacttatggcttatcaagcagaaggagaaaatttagttccacagactagaatatttgttttaacaaataaaccggaatgccaaaatttaaataaccatatattacaaataatgctcaatttatcgaatcatatcaagttttgtcatccaataaaactatcatcaagctctgaaaatttccaaaactttatatgttcactctctatcgtaattttaaatttagatgaagaaatagacttaataaaaaaaattagtattgctgtcaagaggcttcctaattcacggaaatacttcatttacattggatcaagtagacatgtttttgaaaacttaattttcaatcattatatgctttatgatgcactaatgaccaaaacttttcaaaaagatgatggaaatatattggctgctgatatttgtaacattctaatacacaattctattcccttaaatagttcaaacactatacaaatttctgtcaaaagacagaagttttttctaagattggatgatatattatttgtaataactgacaatcaaccgcataaggtaatatttcatttgaaatatgatgaatatcaagtccgtatgactttaaaacaagttcatcatcaatgtcgtaatcttactgcttgccatgaaggagccttagttaacctaaaaaacatcactaaatttaacaagagcaataggatcctatattttgaaaatggtgatacttgcgaggtttcaagaagatatacaaaaaagattagtgatttaatcccgatgaagacattttagttaccgaataagatagttgctctccaatatgtttgtttttggtttataattttcttattaaaaggagggtattaggaatgagtaaattggttaagacacttactataagtgaaatttctaaggctcaaaacaacggtggaaaacctgcatggtgttggtatactttagcaatgtgtggtgctggttatgattcgggaacctgtgattatatgtattcgcattgttttggtataaagcatcatagtagtggtagtagcagttatcattgttagttttgtgaatgttttagacttattaagttacgttgatagagtatttattctttgattttgtaatttccacaataaagagttatttggaaaatttatgacgcaaataaggaagacaataacataataattattgtcttcctttaaatttctctaagtgaataattagcagttagcgctataaaaagagtgtttctgatcttgactatttagtattaaattcaagatagaaaggtacaggatacatttatggactaacattaatgtgaacaatggcttatcttgatgctgtttttaatagaacccaaaatcacaaggagatgttatttatgggaatattcgaagatctaaataataatggtgacgactttgtaaagccaatagatttggggcaaatattttccaatttgaatcaagttcaaggttatgattatcctcgttctgttcaatcagacttttttaaagaatggtattcaagaagaagtgacaaagatttaataggaattctaggtactggaacagggaaaacattgttaggattactagttttacaatcttatcttaatgataattcagggccatgtctgtatttatgcccaacaaaacagttagttaggcaaacaattattgatgctggtaattttggtgttcaaacagttgaatttagtagctcggagtttccctcggagtttatcaactcagaggccatattagttacaactttcgataaagttttcaatggacgttctaaatttggatttgatacgccggcatatcaaaaaataggaggtttagtagttgatgatgcacatgccgctattaatcttgttaaacaagcttgcacgctaaaaatccccagagaagataagcgataccaacaaattttatctttatatgacacctcactaaatactcagagaccttcaaaactaaaaaatataaagtacgtttccaattcaaattcttcaatgaaagtcccttattggacagtggatgataacttggatgaattgataaatataataagcaactccgaaacagccagtgctattcagctaccgtttgttctagaaaatgaagaattgctggatgttttcatatcttataaggaaatatccgtcaggcctcagcatgctccaatcaatttaatatcttcgttctcagaagcgaagcatcgtctgtttttatcggctacattagctgatgcaggggactttatttccgaactaggggtagaaaagggtgcggtacttaaccccataaaaatcaattcattaaacgacacagggcaaaaatggatacttgatttttctagagtaattccgacagtaaatactgataagatccgggaatatgtgcgaacaatatcaactacttataaaaagaatgttctggtacttaccacgtcaaattattacgctggtttttgggaggaaaaaggcgctaaactatattcggccggagatcttcctgagcttaaaagagatttaaaaaataaaaatccaatgattgcagttttggcaaataaatacgacgggatagatttaccaggtgatttatgtcatataacagttattgaccaaactccacgtcaatcatctactgctgacaaagcaaatattcagcgtcttcctaattccgattcattaaatgcaccaattgtacgtgacatagaacaaggcatggggagagctgtacgttcaaaagcagactactctttggtatttgtattggggcaaaatttaagcaactttatatactcacatgatgctcttctaagtacagaaacctcagcacaatgggagttttctaaaaacatcacagataaaatcaaattcaattattctaacaaaaaatcccggctagaacaatttcagagtatcataactggagtactgaaccaagaagaaaaatggactagtttatataaaaccgaaatatcaaaaatatacaacaagcttgcttcggatagctcaacacaacactatacttttaatgttgctttaaataacgcatggcttgcagcacaacaaggccgttatagcttcgctgtaaatgagcttcaagaaaaaatatcaagctttaataaatcagaccaagcaatcttatatgaatgtatggcacgctatgaatacaaagttaacaaacaacattcatctgatttacaaattaaagcacatgaactagaaacacatctttttaaaccgctcaatgttttgtatgaaaaacacaccttgccaaaaaaagaacaagctacggcatcccttaattatctaaaatcaaggaatttaaaagacagcaacgaattagccagttatattgagtcaattaatagtaatctaaaatattcttcattttcaagcgaagaagatttcagggaagcaatacaagatcttggtagccttttaggctgtaattctagtcaacctgaagcagaagcaatcataaaggatggtagcccagacaatctatggctttctgataccaattcattcgttatagaagataaaaatcaagttactacttccaagattagcagaggcgatattcagcaaataactggatcttcttcatggtttgaaaaaacatatagtattaactatgttcccgtactttttcatcgttcaaatattatgaatacagatgccaatactaacttagaaatctacgtggtaaacgaaaaaaattaaaaactttaaactactctcttcataaacttgctcaaattattggtcaaaaacctcttaatgaatggaattcatccacactgatgcaagcattcaaagatagtgacttattaataaacgactttcgacaaaactattgtgtcaaagcaactaaggcttaagttatctgtgtgtattttgaagaaaattgaccataatattacaatacagacggttgaaattaataaaattgattatccaaacttagattttttatctcgaaagagttttacggacaagctattaatatacaaaaagtattaaaaaactaatgacattctcaatagctttttagcaagatttggtcacaacttaataattgtggcctccttttttataatctatagctgaaaatggcagaatatcataatgtatgcttataagccatttattaatgtgagcaactaaattagtagccgtaagctattagcgaaaagctttgttaactcactttttaggttaattgaacgcaaaataagtaacctagatattaatcgcattagtatctctaaactgaagtcctactcgtgatatgaaatccttaagcagatcaaacaatccctcagatttcactcaaataatcgtccgttaaaaataacgaacgtgtgctcagataacgcttatttaacagctataccaaccgatttttaatattaattactgtctgcactgctacaccggtttcagctgcaattgcacgatagctaattggggcaccggttgctttatttcttaattgatcaacgatacggcggtagataaatcgtttttgtgggttaggtgcgtctgcggcgtaagcgggccgtgtccctcgatatttcccattggctttggcgatttcaattccttggcgctggcgctcacgaattttcttccgttctgtttgggccatataagctagcagtttggttaacaggtcaaacataaatttatccatatctgaatcgccggtgcgcatagaaagaaatggcgcatctaagacttccatcttaacttgtttgtccctgatctgcttgataatatcactggcatcatcatagttacgactcaaacgatccaaggacgcaatgaccagcgtatcgccctgtcgaacatacgcaatggctgcttgtaattctggtcgattttcggttgattttcccgattgcttttcttcgaatattttttcacacttagcttttttaagtgctttgatttgacgcgctaaattctgatcagttgaactaactcgggcatacccaattttcatcacgacttctcctctcggaatttgatcctacattatcggtaacagattagacactcaaattagacatttttaacagattcaagaatcgcttaccgtgcccgatagaatctcagttttttcctatattcttagtataacgcttattgtccatttagggtacactcaaattatatattgtggtagattataaaattagtccgaacgctgttcggacaaaaaagaccagcttcctttaaaatggtgtttaccacaaacccattcttaggagctgatcttttgtctagtataacctattcggaataaattaaaatcgaaactttttgtgagctaggcctgtccaatatccaaatggctgatcggttaaatcgatcaccagcttccattttttatgagttgtcgcgatgtcaaccttatcaggctaaattggcccaagcagatgctgaatataagcgggaaaaatgtggccgtacgactaaattgaatgctaaattaaagcaaaccattctaaaccatttacgtctaagctggtcaccagaagtaattgctcatgaactaaaactagccactaaatccatttataattggttaaatcaagggcaaatcgagttttccttgagtgcgctgcctgaacatggattacgccaacgttctaagtataaccaatcattagaacagttaattgaacaacgaccaaacgtaatcaatcaacgtaagcacatcgtgattttgaaatggatacggttgttggccctcgtggacatagtaaggcagttttattaactttacttgatcgtaaatcacgttttctttgggcctaccggttaaaagatcggacagtagcaactgtcaatgaagcactgactaagcttttaacaacttttaaagggtccggtgagcagtcttaccgtggaccgcggcactgaatttagcggcctggtttcatttgaaccacagtacggtattcagatctattactgtcatgcttatacaccggctgaacgcggtagtaatgaacgctttaatcggaacttacgttatttttaccctaaagggacttgttttgagcacattagtgctcaaaatttgaccactacgttactccaaattaaccaaaggccgctgaaagtactcaactggcaaacaccttaccaagtcatgctgactaatttgtcaaaaaattcggattaaatttgcaatctaccttaaagaatataaaagagaccaacaaatgaagcatttgttagtctcaaatcatggctagtataactatttgctagctgtattatactaatttttcggtaggacactactccaaggttaatgttgccctatatcaggttatttccatataaaaaggaatggaattgccagttcccttaatcttacgagttacattgcaacaacatcattctttagtctgaccgcctgctcaaaattatcagtgataattccggcaacgtgatcggccaataatctcttttggtcttttggatcgtcaactgtccagattcgctcatccacatttgccagtggttgataatggcttaaatggagccctgccaagtgttcttttagaatcagtgtcttagcatctttgatgacatgatccgataacagacaatattgttgagatgggtcgatccgatatgcaactttcagtgaatccaagttaaatgaggagtagataactgggtaaatcaaatcatattgtttcactaagtcgagcacaatctgctcaatgtttggataatgaatcttgttggttttgaattccaagttcaaatggactggacgatgaacagctaatgccagcaggtctttcaaagtaggtatggtctcgccatcccgcatatgaaactgttgaacctcttgtaaagtgtacctgttaatcaatcctttgccatctgtagtgcggttaatcttttcatcatgtatgatgactgggatattgtccttagtcaaatggacatcaaactccaacccatcaatgccatgatcaattgcatacttgaaccctttcagcgaattttctggaaatttgaacgggtaaccacgatgtccaaaaatcaatgttttcttactcaaagtgggtaacttcctttcaattcttcaactctcttaaccgacttccattaagattcagcaatggaactatctgtcatcagccttgttagtggttttcaggttagcgttcatggctttattagctgtgtttaaggcactgttaatatcggcgccattatagacactttccatggcggtttcttccaactcacgagtcagctgcatcccttccatcaaaataccggagttggtattgtttggtttggcactggccaactgctcaccaggaactttggcagccgggacctttttgtagagatcctgcaacgtcttggtcttctgtgagttcttgtttagagccaagtatccggtagctttttgccagttggcttgattcttggcggtttgagtaaacttgataaactcccaggcaccacgttgggtcttggctggtttatcgttggaaatccaaagagcagccccgccaattccaacaccgttggctttaacgccatctggatgtgggaagtaggaaattcccaatttattcttcgtaccggtggttaattgaccgatataagctgacgactgaacgaagattcctaacttatttgccaagaatgccgctatttcatttgtttcagcactggaaccagaaccgtagttgacgaaatcgccggatttaatattcgttctgatccaagttaagaatttcttggtggttggattattcaagtcaatcttggttgggttgccggtatggccatccccgttgttaatcaatgaggtgtgagcattagcaagtgcttcttccatcaaccagccataaatttccatggtcattcccttaaccttgtgatgggacttttcatatagttcctttgcagcacgggtgacctcgctataacttggtgatttagatggtggcgttacaccgtacttcttgaacaacgatgaattgtagtaaagcactggttgcgatgtgttaaatggcatggctaactgagtgcccttatttgaatagaatgatcgggcaaccggtgaaatatcgctcgtgtcgtaattgtcctcatcgatgaatttctgaaccggcgtggtgtacttactgtgcatcatctgggcagtggaaatgtcaaaggactggaacagcgctggtgaagcactggtaccgtgactttgaataatcttttggacagcctcatcataagcaccctggtattggggaatgacttcgtatttgtcttgagacttgttaaaatcatcaaccattttatcaagcgcaacttcggcaggcccacccatttcattccaaaagacaacagggattcgactagccttagcagcgctggcattcttgtactcattcacaaagacaattccgagcacaatcgcaaacacggcaaagattggtagtgcgtagtttttcataaaggcagccaattttttcatcatttgactgcaccttcattcacaccagatttgaagtaatgttggccgatgaacagcacaatcagcgttggaataactacgattgcggcggtagcttgaatcataccccaatcgttaaaagtttcttcggactgtagttgacgaagaccattttgaacaggtcgaaaatcgttactgaaggtggtcagcattggccacaggtattggttccaggcacctaagaagctatatgctccaagcgtcatcagtgggattcggttatatggcaagaccattttccaatagaactggaaatgacccaagccttcaatatcagcggcttccttcaattcgatcggcatctgcatgaatgactgacgaagcatgaagactccaaatgcggatatcaggaatggaataaccatgactgagtaggtattcaagagaccaagtgctttaacggtttgaaagttgggaatgatttcagcttcaaatggcagcatcatcgttgccaggaacaagccaaacaggaacttccgacctttgaacttgagaaacacgaatgcataggcactcattgaacagaaaagtaattgggcaatcatggttgtcgttgagatcaccaaactgtttcccagatatctaagaatcggcgtttgggtaaaggcatcaatgtaattttggaaggaaacttgagtacttaagaaattcccctttgcgatttgcatagttggtagaaagctagtccacaagccgattaggaacggtgccagaacgacgacggctaaaacggtcagcaagacatagtcccaaattcgacgtgacagctttggtttagtaacaatatccattagtagttcacccgcttttccaaaactttaaattgcagaagcgtaaacagtgcaatgataatagtcaaaataattgattcggcactcgcctgagcatagttaccactataaaacgcgtctttataaatccggtaaaccaacatgttagttgcgttggttgggccacctttggtcatcaaatcaatcaggccaaaactcttgaacgattcgatcaaagtaataattgaaacgaaaaacaaagttggggagattgatggaatggtgatgtggaaaaattggaatctggatgaagcaccttcgatattagctgcttcatataacgtggtgggaacagaggtcattgccccaagtagaatcagaaaagtaaagcctaaattcatccacacggtggtgacaatcaccgcccacattgcggcagttggatcagtcaaccaagggatttgtggtaagtgcatccatgtgcttattaatgataagaacccagttgatgggttaaaaatgaatagccagaagattgcggcaacggatacggaaacgcccatagttgccgaaaacagtgtgcgaaaaatgccaattccgggcagccgcttgctggcaaggtttgcgagaaccaggccaagtgcaatcgtgataattgtgactgcgaatacatagaacaatgtgacccctaggctggaaagatagtcagcagaggttaatagattaatgtagttggaaagcccaacgaacacggttgttttaccaacggtatttgtcagaaataaactaagatataatgtcttaaccattggataaaaaatgaaaactcctaagattagcagggacggccccagaaacgcccaggcgaagtatttatccttggcatttaaggtaaatttggcttcctgatcggcaatttcacttttggttttctcaaccgaaggcggcgtcgttggggtactttgtgctggagatttaagcatgaacgtaagcctccttcgaaatattcatccaattaccttctgcatcaaagaacatcaaatgagaatcagtagaaactttgattggttgggaaatgcggtagtggacttgacctggtacaagcgcgtgaatatcctctccactgtttaaagttgcgtagataattgtttcatcacccaaaaactcagtgtttttgacggtggcatttgcttcaacactctcagttgcttctactttcatgtcattgggccgaatcccaattttgacattctctgccggtacttcctcatccaatgcaattttcaaatcagatgaaacattcaaaacatggttatcggttttcgaacggtgtgcgtttagaatgtttatttgtggtgttccgaagaacttggccacaaagtcattggctggattttgataaatttcacttggggtaccgatttgctgaacgtgtttgtcattaagaaccatgatgtggtcagccatggtcattgcttcaatctgatcatgagtaacgtaaatcagggtcaatccaagcttgcgttggagtgcatagatttcttgacgcatcttaattcttaattgcgcatccaagttggacaaaggctcgtccatcaaacaaatcttggcatcactggcaaccgcgcgggctaaagctacccgttggcgttgaccacctgataattcacgaggtttacgttttgcgagttcagttaggttaaccattttaagtgcctcatcgacacgttgtttaacatctgcttgatccattttacgggccttcaaaccaaaggcgacgttatcccagacgttcatgaatgggaacaaggcatagttttgaaaaaccatcgttaacttccgtgccttggggggaaaatcattcacaactgtttcgtcaatactaacttcaccggccgtaattggcgtcaaaccggcaatcattctaagtaacgtactcttcccacatccggaaggtccaacgataacgaagaactcgccagtctcaacattcaccgaaatatctttcaaaacctctgtctgcgcgtcgtaatctttgcggacattttttaaagtaattgacaaatatctcacctcaaaatcatttatttggttacaagggttattataacggttcgatgtaaaatcaaggtttcgttaatgtaaattgtaggtaaagatatttggggccatgtaaagattaaatataatccccgaatttaaaattgaagtgcaacactaggtaactagaccaaaaaggtcatgatgacctattcttataagtgaacaagcaataagaaagaggacttcatcatgacccaatctaaaattagcatggttcgacattatacacaactatcactggtcgagagaggataaatcgaagcttggcgaacaccacaacagttccctgacgggactgttgaaccaccattatcgatagctactattgctcgccgtttaggtcgccataaagcaaccattagtcgttaaattaagcgcggaacaaccacccaactcaaagctaatcaccagcatttaacaatctatctggctgataccggtcaggctgtttatgaacaacatcgaaaaatcagtcatcgacaacataaatggcaaagttgtaccgacttttacaaacaattaaccaaggagtttcgacggcgacccccgagtccacagcgcggactctttcgtgcatgcctatcgtcaaattttttccagccggttatgtccttcaacaccaacagtttatcgtgacattaacgctggtgttctatctttacgtaatagtgacctcccaatgaaactccgacgacgaattaaaggtcaaggacaccatcacgttcgtattaataaacatgtcctcggccaatcaattgccgaacgatcggctaatgttgataatagaactgaaattggtcactgggaaggcgatctcgttaaaggtcaacaagcccaagacgatcctgccttaataacattaactgagcaggtcacacggcttcagattatctttaaaattcccaaccaccacgccgacacttaccggcaagaactgcaaacgattctcgcggattatgggactcaaaactttaaggcgattacttttgataatggtagtgagtttgctaaactgtcaacgattaaagggccggagatctattttgcccatccgtactctccatgggaacgtggtactaatgagaatcataatgaactcattcgggaatttatcccgaagggacattcactacatgattatgatattacgatgatccaagcagttcaagctgcactcaatgaccgtcccagacgcctagttgtctgatgcctgatctgtgctcattactagaccaattatgagaataggccactagcgttgcacttgattttacaattcaggtattattaattttgccattaacagaacaaaaaagttttttggtagtatctaggattgctacgtaccttgaaaggcaggggatcattgtgtgatcgtttttaatgtccatgctagaacttaaaacttcaatcggtattcaaagtataagataaaaattttgtcaatgacgtttattattagcagtagaatgtttttagccattggctgaccattaatgaacagttgtggcctcttttttgatactgtataattaaagggttagatccgtgtcattacttaatgacataaataaggagataaaaagatgaaatatggctatgcgcgggtcagtaccactgatcaaaaattagcaaatcaaattgagttactaaaattggcaggagcagaaaaaatctttcaagaaaagtttaccggcacaactaccgaacgaccggagtttcaaaaactgttgcgcgttctaaaaacaggcgatactttgattgtcactaagttggatcggtttgcgcggaacacacgcgaggccttagccattatccaagagttgtttaaagaaaatgtcaaagttaacattttgaatatgggcttaattgacaatacgccgactggccaactagtctttacaatatttagcgcctttgcgcagtttgaacgcgatatgattgtcacgcgcacacaagaaggtaaagtgtatgccaagcaacatgatccgttgtttcgggaagggcgaccgaaaacgtattctgaggaacaaatcagatttgcctacgagttacgaaaacaaggcatgacctataaaatgattgaacgaaagacggggattagtaaacgcacgcaacagcgacgatttaaattagttaaaaacaatatattttaaaactgtttacaccataccaaaaggggcttcgaatacgaggccccttttagatttagctagtaatccgtattaaagttaatggctagctcccagttcaactttttaatggcttacgatctgtcaacaaagcacttggtgacagaatcaaaacaatcaccgctcctactaagtaggtatgactgaaggcctggctgatctgtcgattcttagtatgcttaatttttctcaaagctgtcgttaaagcttctttttgtgccaattgtttgagacctactaacaattttttctgaccctggcttattttctgattacccaaattaattttttgagaagctactgacagtttagatatagcggtattttgattttctaacttggttaaagtaagtgctagttgctggttacccgcttttaagttgtcagtagctagtgctaacttcttctgggcttggtagacctggtgaagatcggttcccttttggggctatggtaaatcaacttgagatttggccgcttgtttaagggcacgtcttaggttcgtctgtttgtttttagttgttaatttggctgatccagtagtggaaaataggctgttcaattgttgatgagccactttctttactttaggtgataattgctgtcgatcaacaatttgaatggtatcttgatgcatatgctgcttagctgtattgacattattatcaaagaccattactagaattgcaattcctaaacaggtgccaatttgacgcgctgcattaacaattcctgaaacaatcccacttttatttttgggcaaatgcttaaccaagaccactaacgaaaccgaagagaacccaaaaccaacaccgttgatcactaggaaagtaatgataacagctttaggcgttgtggtggtgataaacgacaagagtagtaaactagctgccatgactaagagtccaatcaaagtaaccgaaactgcgccaacttgatcaaataacttagttcccaaaggcatcgctaccatgattgtttctgtgggtatcgggtgtgaccgatgccttttttattttccattatatcaaaaggcggtccagtgagaatcttcggattctcactggaccgccttatttgtggagacttatgtcatagcctcttattttttcctactactgtcaacacgatcacctaagatcccaactaatacgccaacaacaaccagaatataaccaactaaatcatgatatggaaaatcgtagtgattacttgcccacagtatgattaaaagaattacaactagggttgtgcgaagccaaaagctttttctcatactatttggctgccagtggtaatttaaagatgataaaagtcgatatagcgtaaataattaaaattggaatcagtaacattccataggtgatgggccacgtcaaaacggtcattaaggcagtgccaacggtatttaaaattactaacgttttcctggttagtttaaatgaatgccacattaaaaaccaccagtagaccaatgagataagcagtacaaagcttcccaattcagttaatgacaatttatattcctcctagacgttgcttatttgtattagcactatggaacataatttagacaggctctctaaattaatacgttttgattttataagcgccaaaacgattaatgtccatataaagtttactatgcgggtgagcatctctcatattagtcaggtgatctgctatattgctaaaatagacagaaagggtaactccgactggtggagatacaagtgatccaaattcagcaatagcttgaccatttttgaattctgctatctctttatttactgctgtcttattgcgcatatacaccctaatcccccaccaaaaacgtttaatagttggatttgatgaagacttggccaatactacaccgaatgctgcacttgttgaagctccatatgtcttatcattagtcttgatagtatagccgttgcttttaatgtcagcattgacttgtgaaagctcatcttctatttctgtaaccatgctttgagaaacattattattttcagggagctgtaatacgtattgattattaacaacttttacatatggatcaagttgattaatttgattctcagtcaattgattattttctgaatctgataattttgctgtttcagttgtttgaccagcatcctatatgacattagtttgttttaactgggtagtatctgcagaagccctgcttgttggtatatatgtggcagttaaaattgcacttgccaatagaactaaccctaattttctgtttttcattgttcatcgaccttctaaagtagcaaaatcttagtctacgaattatataaaaatatttacaagcaaaccataagtcttatttttagtattttcaattataatactcatacgcgtggtgctagttaaatttagacagtaaaaaagcctgacggtttacacttaaagctcatcacgaggtgggtggcttttttgtgtgcattctgcttcatttaaacggacaagtatacgtctaaaaggtgaacgtgttgtctgagagcgcgtgattatttactttttagtttatagtcaagcttatcctttgtttccatcatcgataccaattcatcgtaagtatcacgtgtttggggagttagtgattcaagataactttcaatcatcaaagcaaccatttcactagctgaacgcttatcagctgttgctttagacaaagccaaaacggcgtttctggtatgattatcaactcgcatgtttacatcgaaggtaggaattttttccacactatcttcgccaaaacctgcttgctttctagaaattgatgatacatttacgtttaccttcttatcaggactttttacctgatcatcattaccgtgtttcaaaagtccccccatattattctgcctccaatctagatattaattcagtagcaacagccgtatatgtgctgtgagtagctttatcccaaacagaacgactgctttcagtgattccagtaaggtcgtatctctttactctttccatagcagtaatgacattttcaaatatgttgtcttccccaaattcttctacggcctgtttaagaacggcattgtcaataattgattgcccttttgtaagaactggaagaatacctgctacatctacttttgctccaaattcgtcaattaaattcgtttgtaaatagcttaagaaactttttgctcctagcaatgctctttgctgagtttgtagcataacaatgatccagtcgcagcacataaaaacgttatcgtttgttaaactcattgtagggcttacatcaagaaacacaaagtcgaatttgctagatatatttgacaaagagtttttaagatagctgactttagctttttcatcaatgtcttgtttatcaacccaccgactgaataagttcatatcagcagcagctggtattaagtcaagaccgttcttaatgttaatgatgccgtcatttaagtcttttccgttaattagtaatgcgaaaagagatggatcaattgtgatgttggaattttcgtgactttttgtttttatcattaaatcagttaggtttgcttgagggtcacaatctaccataagcactttatatcccatatttgataattcccaactgattaaggctgtagtagatgttttaccagtaccacccttttcattggcgcaactaattatcattttttaaaattcctccattcgtacacggtacacggtgtactgtgttatgtgtacagtgtaccgtactcagtacacaatgtacagaaaaaaatccttaaccattgaatgcggaatgacggcttttttatgaaattatttaagtgtacagtacacagtacccaatacacggtgtacagtgtacaagatacagtgtactgtgtacggtgtactgtacacaagaaaaattgactaaagatttgataactgatataatgataaccgtagtcaaaatagaacataaaaaaacacccaccgactgtaatcggtgagcgccacataaaagtcatctaagttactgactattatatcatggccggtgcgatttttaaagccctaggggacaagctggggtctaaatccaaggggacacgtttgccagtgcgacttcaataagtctggctataccacaacaaggtcatctgtacggctgggtggtgaatggtgagcgcgaccattaacggcgcgggtggtaaaacgaagcttcggcttggtgccactgattagttggcgatcgaacaaaaataaatacgtattgccaacgcctactagggcgttttttagtaggttaaaccgaaaacgtaggcttataatgagtggtggtagcaataccgcaattgtacagacaagcgacgggcgttaacgaccgacgaactaggggaaaaccttagcgtagaattgcactctggttcagttattccaaatagctgtttccagggaacaattctgcgctcaaaacgtcactccctctaaactgaatggaaaatcgtaacccgtcaagacaaattctaaagaaaaaagaaagttggtggaattattggaatttaaggattacattgttccattgaatccagatgtgatcattaagaagacaatctaccggagttctgcaagaattactgagcgacaaaggaaccaagtgaagagagttttgcgtagtcaagggtatcagggaagaattagtagtattcgatacactcgagtaaattacaagtattcatttaaagtatcagtgaagtatcagtgaagtatcggggaagtgttggcaaatttttggttaatacaaagaatgagacagttgaatttaagggaatggtctaggagtaataccagtaaatttcacaaaatttctttccccaattaaagccaatctgcgacctataccacttcttttttggacaagttcacaatcaaaaaataacggaatgtggaagtaccgcggtgaatgtgggttacttgggataagccccatttatgttaactagcttaaaattgcacaataaaaaggcctacccaattgaggatagacctttttactttattcagctttgtcatctactttaatctcagcactagttgaggtcacattggaaacgttcgcactagttggtgctttatcagcttggctagcggagtccacctcgtttgtaacacgttctaaggtgcctgtcgtgtcctgtgagacgtttacagtttgtacgtctgtaattacatttagcatacctaaaatggtcagaaccgtgttaatggtagattgcaaatttaatccgaatttgcaatctaccacttgacataggagctatacggtaatcaaatgtttgatacccttataaaataacttagcggcccatgctaacgattatcactacgttggtatgagccgcttattaataatttgatttaatcaacttttagtaaaatgggtaattaaggattacgtggatatgccgagtatcaccccataagtcccctttatcctgtatcttttagtttgtattgtttaagttcgttttcccttgacgtaaaaattctattccaccaaagattaatgtccagcagattgccccaacggccccaacaatatcttctgggatgaagaacaggctgatgaaaatgataccgaagaataatatagttaatgggctggtaattttataccatggcataataaaaccatttggtaaaaaatcagtggaagcccggtatcttctgtgagcaactaatgtcaatgtgtaaacaataatatacatatcactagacacgccggttacgattgtaaaaactgaactgatggcagttgttaaactcataatcggagtgattaagactagcgaagcggtaaaagcaattgcagcggcagggacgccactgcttgatatattagcaaacatcttatacatccaactgcttttggaaacttcggttgccagttgataaaaatgacggcctgctgaaaaaatacaactatttaatgcagatgcagcggacgttaagacaacgaaattgatagtggcagcagctgccggaaatccagctaatttaaatacttgaacaaacggactactgtttgctgatagtgacgtccaaggaatgattatcataattacaactagtgcaccgatataaaataataatattcgcaatagtgtttcatttaccgccttttttagcgccacctgcaggcttttttctgatcaatctaagacctaatcaattttgtaaacctttccgttaggtttaagcgtgcaactaggttagaattagattgtgcaaaaccatacttagaggtgttaatattgaaacaaacttggcaaacagcttggccggaacgaattagttatgggctcagtgatgccgcggataacttagtctttcagatgatgaccacatacttattattcttctataccgatgtttacggcctatccacgagtgcagcggcgattttatttgtcgttgcgcgcttagccgatgtcgttgaaagtctgattatcggcgtcatgattgaccatacccattcgcgcttcggtaaaagccgcccgtttttcttatggtacgcgttaccctacgtcttgttcgccgttttgacctttgtgaccccgaatttcggagcaactggtaaactcgtctgggcttatgtgacctatttagggttaggattcttctataccgccgtcaacctaccaatcacatcgattttaccagcactctcccagaatgaacgtgaattaaccttactaggcgtgattcgtcaattcttcggtagtagcgttcaaattatcgtcgctgtcttcaccttgccactagttgctttatttggtcagggtgatcagcaacgaggttttttactgacaatcgttctatttggcattatttcgttggtcctgatcctcaacaccttcttccaagtcaaggaacgctttagtcaacctgagcgtccgcaccaatcactcagtgcggtgtggggcatgctcaagcaaaaccagccgtggtttattttatccagcgtgattttactgtattggttaacaactgccatcaagaatcaaacgaccatctactactttaaatacttgattcaacgcgaagacttagtgccagtcgttaacggctttacgtttgcgtcactgatcggggtcatcttaattgtccggctagccaaccaccacgggaaaaagaataccatgttggcgggtatcgccatcgccgctgtggggcaactgatcctcggtctcgggacagccatcaatcaactggccttcgtcttcggtggtacgttgatcaacgctgtcggtaacggtctcatcattggtttggtctcaattatgattgctgatacgattcgttatggcacggcactgggaatacaagcagaaggtattttagcctctactgatgacttcggcgttaatgtcggcttaggacttggtggcctagtcaccgccggactctttcatttaagcggctacaccgccaatcatgcgcaaaatatcgccactcagcatatgattaccctgaactatgcgtggttaccattattactttacatggtgatgtttatcgtattaattttttacaatgagcagcaattgcaagacgcgattaatgtttagttaattatataaaaatatgaggttagctatcccagaacaacagttggatacctaacctcatattttttatcatgttttttacgaatgaatcagacataagaatcactaacaaatccacaagcaaaaagagtaatcccaaagcatttaaacaaatctacatcgttctatcaaaccgtgtgattgcacaaaactctataattggtcctccaataataactaacgcaccaataccaagcatacgatccagtggcaccaacattggcgttggagtccacaatgacagtatcatcagaatagcaatgattataatcaacgcttcatagtacgttttagtaacggcacctgctcttaatttaagatattgccagcgctcatcattatgataatctttttgtaactttgccattcgacgggtagcgtacaaataactccctatgaaaatcaatatgattactatcaatccaactcgttcaatcatcattttacccccgataaaagacatcctcaatcatacagtcaaaaactgttgcgattttgaaagctagatccaatgatggataatatctagatttttcaatcgaaataaccgcttgccgtgaaattccaagccgctgggcaagttcagcttgcgtccaatttcgctcagctcgtaacattttaattttattgcaaatcaaagtaacaccatctttacaaaaagtaaggttttgtttacaacgttagtataacaatatattatacttttgtatagtttccactaaataatatcgcgtaatatcgtttccgaatcaagactataaagatcacaataccaattagaaagacaaagcactaatttataatagcaaccagaaaaggccacactggcactcccaggtggtaagtcagtaccaagttccccaaaaaagcgcaggaaaaaagccgaccccgaagagtcgactttttctgaatcaaaaatccaattatttaacagctggagtcttgaaccagccaatccgtgatgtaacaacatcaacgatggccttcttaccaggtgccaataacttacgagggtcgtagcccttaccgatttggtctgcgccagattcaatgtaagcacgagttgcattggcaaaagcaacttggttttcggtgttaacgttaaccttgctaatacccaattcaacagccttaacgatttggtccttaggaataccagaaccaccgtgaagtaccaatggcatcttaacggcttctgagatttcttgaagacgatcgaagtgtaagccagtccagttttctgggtacttgccgtggatgttaccaatcccagcggctaagatgtcgataccagtagcagctaaagtcttagcttcttcaacatcagctaattcaccttcaccgatgataccgtcttcttcaccaccaattgaaccaacttcggcttcaacagagatgcccttagcatgagctaatttgacgatttccttagtcttttctaagttttcggcaaatggtaggtcatggccatcaaacataactgatgagtaaccaacttcgatacattccttggcagcttcgtagttaccgtggtctaagtgcataacaacaggaacagtgatgttcatgctttccatttcatcagcaactaagtccataacgagcttgtagccacccatgtacttagcagcacccattgaaacttggataataactggggtgttagtgtcttgagcacccttcaagatgcaacgagtccattcaaggttgtttgtgttgaacgcaccaatagcataatggttcttgtatgcgtcttgtgtcatatcaacagcatttacaaatgacataaaataaccctcctaggttaattaagagatacgatttttgaatcacattcattttagcacattttacataggagtgataaccgatttgtcatatttattaaccaacgattccccgtcaattcttgcttatttgacaaccacccgtttgtaaacccttccatttatataaaatcagttacagatcaagccaaaagttgcttcaaatttaatcaataattaattgtgaatattataacagcaatccgttcggtgaaaatgtaagcgaacagtttatttacatttatatacgctattaaatcaataattatagtgtcttaaaagcaatttatgaaattaaatattagctatttacatttgtgaaaaagtatttataatagtgattgtgaaataagaaacaagttgattttgcataggaggaaccgtgaatgctgaaagaaatggaagaaacaaccgtatcacgttcaatcgatcggttagtcttaaatgcttcgttagctgccaaccgtcttgaagtcatggaccaaagtcaagttgatcaggctgtcgctgccatggcccgcgctgcccacgctgctcgtggcatgctggccgctatggccgtcgaagaaacgggtcgcggaaattatcgtgataaagttgcgaagaacgactttgcagccaaaaacgtttataactacatcaaggatgacaagacggtcggtatcattaatgacgatccagtcagtggtgtgatgaaagttgctgaaccagttggaatcattgcgggggtcaccccagttaccaacccaacatcaaccgtcattttcaatgccatgttagcattaaagacacgcaatcccattatttttggtttccatccctttgcacaaaaatcttgtgttgaaactggccgaatcatccgcgatgctgctattgccgctggcgctcctaaggattggattcagtggatcaagacacctagccttgaagcaaccaacaccttgatgaaccatccgggcgtcgctaccattattgcaactggcggtgccggcatggtcaagaccgcgtattcaactggtaagccggcactcggtgttggccctggtaacgtgccatgcttcatcgagcaaaccgcagacattcaacaggcagtcagtgatgtcgtcacttccaagtcattcgacaacggcatgatctgtgcttccgaatcaaacttaatcgttgctgatcagatctatgatcaagttaagcgtgaattaagtcacaacggtgtgtactttgtcggtactgaaaacttcaaggccttagaagcaactgtcatgaacctggataaacaggctgttgacccgaaagtagctgggcaaacgccatggcaaatcgctcagtgggctggttttgatgtcccaactgataccaaagtattagcagttgagttgcctagcatcggtggtgaccaagtcttatcacgagaaaagttatcacctgtcctcgccgtcgttcatgccaaggatactgagaccggcttcaacttgatgaaacgcagcctagcacttggcggtctgggacatacggccgccttgcatacgactgacgaagctgttatgaacaaatttgccttagaaatgactgcttgtcgggcattgatcaacgtgccggcttcacaaggtgccattggttataaatatgataacgtcgcaccatccttaacactcggttgtggaacatgggggcataactcgatttcacacaacttggaagattgggatctgctaaatatcaagaccgttgcaaaacgcttaactaagattcgctaaagtctcattaatcaagataataaatttaaaattgccgctaacaaatgtgcccgctgaagtcagtctaattgacttcaacgggcacattttaggtttatgatcaaattaagccaacttcttaatcgtccacgcatcgcgaaaacgatccggtcggtacagaaaccaccgccccaaactccaagttaggtaggcgacgaccagtgccattataatcccagtcgataatggcatatgcgcatgatagttatccgttagcaaccctaaaacaccgttaccaaattgtgaacagcaaattgcaacaattagataaataattgaaaagcccaggacggctccgcgccactgcggaaagcggaaaaaatccccactattttccaaagataaatgctcaaacgcccagcggttaagcaaatacaggccgccaccgataacaccacaaatcacccaagtggttagtaagcccccgggtttccagctcggcagctgacctaaaacatccacctgctcatatttaagcttcgttaatcctgcaacaagattgatcaaaccatcatatgcaaagggcaagctgcaaacgaagacaaatgtcgcaagcgcacccgcaaagacatggccaacccataacccgaacgtaacggctaataatccaaacactaacattacggccatgattccgagttcttcatacaatgtcgtaagccaatcaatccgcacctgctgcttagcgagcacgcgccaagcaattagcccaaaaacagcttccgccaccatgtatgcactgaccaacattccaataagtaacccgatcttacgccgataaatttgcttgcgagcgactggtaaactaaataaatattgattaaaattcgtgaaattatcgcttaaaaatagtgcgactcctagcaccagactaacgatgatggccaccaccgtttccatccgaagatgagtggcttccatcaacgcaaaactactgacgtttcgtgcaacgtaccgtgacggattatgggcaatactgtagccttcctttatgcctactagtagtaagacaccgcccgccgttaataacaacgtgcgatagtggcgccataacaactgccataactttcgtttcgtcattttatcgtccccctaagataataattcaaagtcagcttcatccgtcagattagccataaacaagtctgctaatgagagtggtaaatcttcttgaaatactgggctagttgccgccaattgtgcctggacctcagcattataatcttcaaacaccaccacgatgacccgaccagaaacgtgtacaatatggcctaattgtttaacaacggctgggatctgcttgtcacgatacactaattgaacttttcgggcacttcgtcgcatggcctctaattgatagtcattgacgatacggccgtgcttaagcatcaatgcgcggtcaatgaccccctctaattcagtcaaattatgtgacgcaatcacgattgaacgatttcccgtagccacttcatcaattagaataccaagaatgttttttcgaattaggacatccaaaccatctagtggctcatccaaaaagagatacggcgcttgcgtcgcaacactgagaatgattgtaaataaaccaaacattcccttagagaaatggcgtaatttttgcttggatgtcaaatgataacggtctagcaattgcgcaaatttggcattatcaaagtccgggtaagcagcttgataataccactggatttgcgcaatcgtcgcgcctttaaaaaaattcgccagtgggtcaataaaacacagttgcgtccgcatttccggtcgttcaacaacggcttgcccatcaaccaggacctgaccatgatccgtgaggtactgcccattgattgcccgaaaaagggtggttttcccaaccccgttacggccaacaacaccgacgatctgacccaatccaatctcaaaactgatatcatctaacgtctggtgatggtcaatgcgcttacttaactgattaatcactaaactcattatttctcccccatttgatcaagccagctgtgcaattcagccatactgacgcctctttgacccgctagcctgacgatttgtgtaaattgcgctcgtaattcttggcggactagcgtcgaatccgccgccttaacgtacgtccctttcccggggactgtctcgataatttgttgcgcctctagttgcttataggctttactgaccgtattcgggttcagcaagtgttgacgagccatttcacgcaccgacggcagttgttcgccactttgtaacacaccatgagcaatatcttgttcaataccggttacgatctgagcgtaatacggttgtcggcttccatgatcaatttgcatggcccacctccatttaatacacagtcgttacttcgcttacgttaaatagtacagtatagtacagttataaacaagctaagaaaacgttaaaatcaggccacttttccaatccgagcggcggcctttagtccttcctagccgacacgaaaaaagcccgtatctgccaatcgtggtaaatacgagcttctatatatgtgcgctcctactaaaaaagcgcgatattaggttacgatctatctgcgagtcacttacttgcgccgtaattccgttgcggcgtattccataatcgccatcaacacaatcaaactaatcggaaaagcaatgacactaactgttaaactagccgtaatttcaaagaaggtaaaaattaccattaataacaatacggctgcaatcaacatgccagtttcggcctttccccaatgcttaatcatcgtgttaacctcatttctatttattagtcatcacgagtttaacacgtctgatatcgcttactaggccttattgctaagagttccatgagaattctattggagtagccgtgtcatcgtcgtcaccgctaaccggccaccggcttttaaaggtaagaacaactggttaccatcttcaaacccgagtttctgccagaattttgcgaccccttcatcagcagtaacgcgcgttagttggatcgccgttatattcgcttgaagtgccgcttgcatcagtccggttacaataactcggcccactgatttacgttggtaagccttattgaccatgagtaatccaacgaataaaaattgttcttgtggatactgattgagtacatctaaaacggctactaaacggtgtgctaagtaaaaaccaaaaacctgtttttgtgccgccgctaactcgtccgggtgggccgtcaaatcatgttgtacctcagtcatcgttagtggttccggtgagaaatattgatgatagcgcggattactttgttccagctctagcaatgcttcctggtcagctaaagttagtaatcgtatctcaaaatccggtaattgtgcttgtaatgttgctaatttcatgattcaatcccagactttctctaaattataccaagtttcaccagcatgttcggagttcgccacaccttgattaataaaaccattacgttcataaaacgaaattagtcgttccaaacaagtcaacgccatgcttgtccgcccgtctgcttgagccttctcagctagcgcggtcaataattgactaccgatctgttggtgacgtgctagtggcgaaactgccaacgtgaaaaccagctgatggccgccacgtggcaagttagtcggtgtctctacaaacatctcatcttcaatatagcgggcaccgacagctggtcccacgataaagccaagtacgaccgcaccatcgcgggcgaccagaaaagtatccgctaatttctcaatgcgttcgcgataagcagcctcgctgccagcctctgcttctgaaaaaccagatttttcgatcgccatgatttgtggtaaatccagcattttaacaggtgtaatttccattgattttcgccctccaattcgtacgtatattatagcaaatgtcggtcaatagttgactaacttaattttccccgaaaaaccagtgtcgaacgtgtcgttttcagaaatgtcatgctatacttgaattgtgaattcggttacatgcattcgaattcaataattctaatcgaaattaggtgacctttatgcccgctcaatcagcagaacaattatggcatgcttataacgaaagcaccgacacaaacggggcttcttatcaaacacgttggttcggtcaacaaaataaccctgccgaagtgactgctttagccgacgcaattctggctgggacgaagacagcgacaaccacgccgctggatagttataccgcggaacaaattgccattccacaagttggcgactacaacgtcttgctaaatggtgacatgaaaccggtcgcgattctgaaaacggtggtgtctgaactcattccgttttatcgcatctcggcggaacacgcttaccatgagggcgacggtgatcgcacaattggcgattggcgcaaacgcaagacggcagaattcaccccgacgctagaagaacacggcaaaaacctctcatcggacacaccgatggtcagcgaagtttttgaagtcgtttaccgcgcggattaatcaacaacgctaacggcctaagacggatgtcttgggcttttttattagagtgtgagggggccgcgggttgaagctgagcattgcctagccagcgcaggcttcagcggcactccgcgaaaggttcacccacagcgtcacctaatttattcactaaccaaacgacagttccaacccctcaacaccactgtttctgggcgatttgaccagacaagctggcagactaaaaaaaaagaagctgccaattgtaaaaaatgcttgtcaccacgtcatttttcattataattaaagctcgtactaaacttattgtttagtttaacaaaactactgattcgaggtgaatgtcatggacattggtcaacgcatccgcaacttacggattcaaaagcaactcacgcaagaagaattaggcgaacgaactgaccttagcaaggggtacatatcacagttagagcacaatcagtcatcgccttcaatggagacgttctttgcgattcttgaagtactcggttgtgcccccgctgatttctttgcggctgagcagcccactcacaaagtggtctaccatccagcagatcagaccacgtatgacgatgaagccttaggataccgtgtgaaatggctcgtacccgcgtctaacgaaaatcagttagaaccggtcaccgtcacgctggcacctagtggtcgcttcaaatcttttgagccgtcgccggcagagacctttattatggttcaaaccggcactttaagcttacaactcggagctcagcaatatactgccgcggcgggagatacgctgtacttccatgcgactaagacgcatcagattcgtaatcttggcaccacgtcctgcacgttcaccttggttacgaccgcgtcctacttataatcatgtcacaaccaatcgcgctggtattaggttacactagcacggtacacgttttaaggaggtctttactttggcggttaatacacaaccaatcattcgattaacaaatgtcaccaaaagttacggggaacatcaagttttaaaaaacatcaacttagatcttgaagcgggtaaattctatacgttactcggtccgtctgggtgtggtaaaacaaccattctgcgtaccattgcggggtttacggatgccacttccggtcaagtttactttgacggtcaggtcatcaacgacctaccggccaaccagcgacaagtcaacacagtctttcaagattacgccctttttccacacatgaatgtcgcggaaaacgtggcatttggcttgaaattacacaaagtgcccaaggacgaaatcgagacgcgggtccaaaaagcactcgcgatggtccaactagccgatcttggggaacgtgaaatcagtgagatctctggtggacaacaacaacgggtcgccattgcccgggcactcgtcatgcagcctaaggtcctcttactcgacgaaccgttatcggccctcgatgccaaactgcgtaaggatatgcagtatgagttgcgggaccttcaacaacgcctcggcatcacgtttctctttgtcacccacgaccaggaagaagccttggccatgagtgatgaaatctttgtcatgaacgctggcgagattttacaaggggggtccccagttgatatttacgatgaaccgatcaaccatttcgtggcgaacttcatcggtgaaagtaacattatcccgggtaaaatgctcaaagattttgaagtggaatttgtcggcaaacaattcgaatgcgccgatgcgggaatgcagcctaatgaatctgtcgaagtcgttcttcggcccgaagatctcgacattgtggccgcagatcaaggcaagttagttgtcacggtcgactcccaattattccgaggcaattatttcgaaatcgtcgcttacgataccgatcataacgaatggctcgttcattcaactaatcctgccgcagaaggcgaaccgatcggcctgacctttgacccacaagacattcacgtcatgcggttaaacgagagcgaagctgcttttgatgctcgtcttgaacaatacgaagatgattaggaggtgtcaacatgcaaccaaaacaacgattaagtcgtaacaccgcctactttatcccgtacatgttgtggatcatcctcttcgtcattgccccagtcctattgttgatctatcaatcattcttcaacattaacgggcaatttacactgggcaactaccaaacgtatttttcatcaaatacctacttgatgatgacgctcaactctgtctggtacgccttcttgatcacactcgcaacattattgatcagttatccgacggcttatttactcaacgaaacgaagcatccgcagctgtggctactcttgattattatgccaacatggatcaacttattacttaaggcgtacgctttcatcggtatttttagtcaagccggcatcgccaaccagtttttgagtttcatcggcatcgggcccaagcaattgctctttactaatttcagcttcatctttgtcgcggcctatattcagattccgtttatggtcctgcccatttacaactcaatcagcgaactgaacccatcttacgtcaatgctagtcgggatctcggtgccacaaattggcagaccttcaatcgggtaatttttccactgacactccccggtgtgaaggctggcattcaagccgtcttcattccctcgctgtcactcttcatgttgacccgtttaattggcggcaataaggtgattacactcgggactgcgattgaggaacacttcttgacgacgatgaactggggcatgggttcgacgatcggggtcgtcctgattatcgcgatggtcatcatcatgtggctcactggtggcagtaaaaagcgcgcacgaaaggggttgacgaaataatgaccttacgtaacttcaagtggcgcaatttatacttgtggctcgttttcatcgtgctgtatgcgccaattatttttctggtcgtttactccttcagccaaggtacgactatgaacaactttcacggttttacctggcaacattatcaagacttattcgcggatagccgtttaattgccatttttctcgacaccattttgattgcgctcttatcatcattattagcaactgtcattggcacgctgggggcactcggaatcaatagtacgaccaaaccgattacccgcaatacgttgttgtcgttgaacaacatcttgatggtttcacccgacgtcatcattggggccagtttcttgatcttctttactgcccttaaaatcccgcttggttttggctcagtcttgttaagccacatcgctttttcaattccaatcgtggtcttgatggtgctaccgaaaattcaagaaatgagcaccagtttactggatgccgcggctgacttaggggccaacaattggcaattgctcagtcaagtcatcgtgccctacatcatgcccgggatcttttccggcttcttcatggcgctgacctactcacttgatgacttcgctgtcaccttcttcgtgactggaaacggctttagcacgctgtcggttgaaatctactcacgggcccgtcaaggcatcaacctggaaatcaacgccctgtccggtctaatgttcctgatggcactggtgttagtaattggctactacttcattaaccaatacagtagtcggcaccggcggccagcagttagggggcggcggaagtgaaaaaattattaagcattatcgttagcttactagtcgtctgtggcttactggcctttggcgcgcaacgcttgcagacgagctctggtagtactggcaaaaaggttttgaacctctatacttggggtgactacattgaccctagtctgctcactaagtttcaaaaacagactggctatcacgttaacgtcgaaactttcgatagtaacgaagccatgtatacgaagatcaagcaaggtggcaccagttacgatctgaccgtgcctagtgattacatgattgaaaaaatgaaaaaagcgcacttactcttaccgctcgataaaagtaaactgactggaatgaagaattacgatccgcgcttcatgaacctggcctttgatcaacacaatcgttactcggtcccatatttctggggaacgcttggtatcatttataacgacaagtacgttcagccgggcagtattcaacactggaatgatttgtggcaacgaaaataccacaacaaaatcatgctgattgatagcgcccgcgacgtaatggggttcgccctcgcatcaatgaatcagtccatgaacacgaccgatccagccacgctattggctgcgcgaaacaagcttaaccggttatcaccaaacgtcaaggccgtcgtggcggatgaaattaagatgtacatgatccaaaacgaagccgcaatcgcggtcgattggtctggtgaggctagtgaaatgttggctggcaattcacacttgcattacgttgtcccatccgaagggagtaacttgtggttcgataacttggtcattcctaaaacggccaaacactttaaggcgatttacgccttcttgaactttatgagtgaacccaagaacgccgcccaaaatgcggaatatattggttacgcaacacctaatcggaaagccaaggcgctattacctaaggccattcgcaacgatcgccaattttacccagacaataacacaatcaagcatcttcaaatctatcaagatttatcgccagccaaagtcggcttgtataatgaccgttacttggaatttaagatgcatcactaatcggatcagcctacttgcttcgaacgagtgacgtcaaagaacagtcgattataagctaaaagggcttgatttgaaacaaaggaaactctgttgttcagagacgatgaagttatatttaggattcaattcatctacgaattggatcctttttcgattctcgtcttgaatgcaatccgaattcggcaaataattttttaccggttcttgataaacattttaatattagtcattagctgaggaatagtatttcctacattacctgggcctactctaaaggattgataatcgctcttttcaaaactgtcataatcttttaacctttaggaatatataagagaaaacatctttgtcactaaattactaatagtggcaaagatgttttcctgtctagatattttgattatgaatactgcaaccaaccatataacaatatctatcctatagttagatacactttctgcatatttatcatatgatacgatttatttgtattataaaccttagtcagcagcttcttgacgattactttgttcatcaagtaattgtgcaacgtttatagtgggcaaaataagtgctggaaattggtttgatgcattagttataccggatactagcgaccgaacataagggtagagaatggcaacagcatttttcttgattaaagtatcaataccaacttgattatgatcttctttctcatgatagacaaattcgccgctgacgctcgccgtaactataaatggatttttcttctccgccagcgatccgatatgcacatcaactgttacaataattttatcttgctttggcgtatttttaatttcaattttgggatttatactaatattctggttagtttccttatataaatcgttttttctataactcagctcgttaactgtatagcttttaaattctaaaactgccattatgcaacacctccaacaaattcttgaactttaaagattgtggtttctgaggaatcattagttttatagaaatatttggccgtatctacatattctgtttcagttaaaaccttagttaattcggcactatcactcgtatctgaatcataagaagtcaagaatccctgtttttcgtaatcttgttgtgcttttctaaaagagacttcttgtgaaagtgtttgaactcgtttattgttctctatctgtgatacttttgcatagctaatacctaatcgttcagaaaagacgcgctgacttaagtgcaaattttctcgtaacttttttatttcatttggttgcatgaatccttttcgatttctataagcattaaaggcctttctaaaattctcattggggtcatcaaaatccaaccaaagttctcctcgagaatctttccagtaatgattatggactatcaagtcagatatgtctttgactcgcatgagttcgtatttccacacctccgaatattcctcagtggtatttaattcttcattgtaaaaagtttttttggtcataatgagtacctccaagaacgtaaagtgaaaatagtctattatttaaaaggatattccaacgggtattcagctggatgagttgaaatccaaaatatgatattgccgcccttaatttgaaattttagataacattcaatattttcgatgtctattccaaagagccacacatctcctgggattctggggtggtgattatccgccattggaccattaacataatcgcgccatgtaatttgttgatatatactgtctaaaattccatctaaatccatacctaacgttactgctgctgaataattctttgcgcgatgactaatttgccagttgtttcttttcaactttatcaaagcaacaatcgctttggcatcttcctcttgagacattcaaaaccaactcacaatcgaattttcacttgtaataactataccacaatgtgtttcccgtgggaaacacattgcacttttacttgaattaacaacaacagccatttagtttctaattttgatagataaatcgtactttatacgacacaaaaatagtgttgatgaattttatccatcaacactaaagattatagaccccaacagagtgcttcaagtcaggtcctttaatgtctaggcgcttactgccatgtcagaccactaatgagtaaaaatttaatattcgcgagcactactagcactagtaccaatcctaaactgagccgatttagccaataacgatccgcggtggttggaaagacgataaattgtaagtttaaaatgagtagcgcgcaaaacgcactgctagccaaccaccaaagtgtgttagaaaacaaggttatcagtaagctgcccgctaccactagggtaaaccacggttgaattggtgttcgtattgatttagtcgtcattttgaccgcccccttatcatgccttcattgtaaggggtgcccataaagtatcgttagtcccaacagctggttacttaattgcccgaatcagcaaccagctgagccattcgacggttaactagtccaaaatagccaccacagaaatcgaatttctgcagtggctatttatcatactactggaattaatttaataattagtgatataagtcaaagcgccctttactgaagaccgttcctaaatgcgcactttccaaaagtgagcggtcagtaataattttcttcaatgctgatgccgcgtagccatgaaccggtttgttactactgaagatttcaccaataccgtcacgatcgctcaatgaggccacggtcccactagattcatagtggaaggtcgccgttgcttggttatgacgcaaagcgccaatattcttggcagcctgttcgccagctgccagtgcaatttgagctgtggttggatatggccgattgctttcgggatccatcactgcagcgacatcccccacaatgaatacttcgggatgcccttccagtgataagtcgggcttaactacgacccggttacggcgctgatcaaaaccggaatcagcaatgacgtgtgaaccactgacaccaaccgtccaaataatagtgttagccgtaaattcatgttcgttcttgtccgcgtcactgtaaaccacagcacccggtttgatggcctcaataacggcacctaaccgcatttcgacattattcttttccataaacttcaaagcgtagtcccgcaattcctgcgtaaacatcggtaaaattgatggcatccgttccaaacaaactaacttagcagcaggtgtttgatacttcgcctgcaatcttggtaacgtctgggtcagttcacctaataattcgattccagtgaacccagcaccacagaccgcaatcttcaaatcatttttgtccttactggtacggtaggctttaaaccgttcttccaaatgttcataaacagcctgtgaagttgccaaatcatccattggcaaggcattttcatcggcgccagctaccccaaatgtttctgactggaagcccaatgctaatactaagtagtcataggttatttcaggatgatcttcaaaggtcacttgtttttgttcaatatcaacgctcttgaccgttgcttgaacgaactggacccgcttaccgataatatctggaatctgataagtaattcgatcaggtgcgatcgtccccgctgcgacttcgtgtaaattagtcttctccgtatgcgtcggtgtctgatcaacaagaatgatttcatcctcagttggtagactcttctgtaaaaacttgacggctcgcatccctgcgtaacccccacctaacaccaaagttgttgccatgatttattaacccctttcattattcctgttgactaatgccgcctgtccagcaattgtgctaacctgcgttgatcacattaatccagttataacttgataactacatggtacactcttcacgcctaaaattcagctaaaacgccacgccattttaattgttcacaattaatctagtttagtgattaaacttactcaatatgctgggtgacattagccgtgactaacgacagactttcaaacaaaacttgttgttggcccggcgttaactgctcaccaaccaagtctgcacaccactgctcataagcatgcaattccgggtacaacgcttgcccagcgctcgttgggtacaaacaccggacctttttattctctggatgtgtctgcttaatcacgtaacctttttttattaagttctgaacggcgcgataattcgtggttcgatccatcttcatttggtcagccaattgactaaaaaataggccaggttgctcacaaattcgaattaaataaataaactgattgttattgaggccgtatttcgcaaaacgttgattaccctcgttcgtgacgattcgcgacaacgtgcccatcaatcttaatgttggtatcatagaagctcctttttattattgcatatgcaattatttgatgataaacttagcactatgctaaggaggcatcaccatgtggtcgattaaaacattctcagaactaacaacaactgaattatacgctatttatgaattgcgcgtcaaaacgtttgttgttgaacaacagcgcatctatcaggaagtcgatgatactgatttaaaagcttatcatgtctttaaaaccgtcaatcaaaatattgttgcatacgcacgaatctttacagaagatgaccatctctccttcggccgggtcgtggtggacaaaaaccaacgcggacaacacttgggcgctgatttaatggcccatatcgaacaggtcgtacaggaacactatgctgatttgccaattcaaattgaagcccaagtgccagtacaaggattttaccagcatttcggcttcacttcgagcggtaccccttttctattcaaccacacgccccacatcaaaatgactaaacctgcgcgacaacgccaatagctgagcacatcacatcggcacatatgcggggacaagagctgacttagcgctatgctgattagaatccaaaactcaaaacgcgtgactcggaccacaatccgaatcacgcgtttttaattgactcatttattcagctttagataaccgttcaacgtcacgcacaatcatcaactcttcattagttgggacaaccatgaccgttaccggttcgtcatctttgctaataatttgttccttaccgtgcatatgattcttttcatcatccactgtcacgccaaagtatcctaaagctttagtgacgcgttcgcggatcatccatgagttttcacccacaccagccgtgaagacaagggcatcaattccgttcatttcagcaatatagctgccgacatacttcacaacccggttaacaaaaatatcaattgctagttttgaccgttcacgggtgtcttgcgacttatcaagatcacgcatatcaggtgacaaacctgaaataccaagtaacccggacttatgattcaaaatgtccacaaagtcttccacatcagagatccctaaatggcgcatcaagaatggaataattgaggcatcaatatcaccggaacgggtactcatggtaatcccagctagcggcgtaaagcccattgaagtgtcgacggctttaccatgatcaaaagccgtgatcgaagcacccgaccctaaatgtaatgtcactaatttaagcgaatccaatggtttccccaatagttgggccgtccgattagcaacgtaacgatgacttgtgccatgtgccccatacttccgcgcgccaaatttctcataataatcgtaaggaatactatataggtaattaactttaggcatatccgcatacagcgaagtgtcaaacacggctacttgagtcgcttttggtaataaatcacggaatacttcaatataataagcctgcgttggattatgtagcggcgcatactcagataaatctttgatttttttcaaggtttgcgaagtaataacgacagagtctttgaaatcttcgccacccgcaacaacccgatgaccaaccccagtgatttcactaagatgagtcacaacattatcgctcttcagccgtgttaagaccattgcagcggcttcttttgcatcaatttggtccttagtttcagaatatttactaccatccgccttcttaattgtgaaaacggaatctggcaatcccagccgatcaaccattcccgatgcgattaccgtttcttcgggaacactgaaaagcttccattttaaagttgaactgccggcgttaattgctaaaatttttgccatgactatttttcctccatccatcatcaagtgtgcctaatgtcagtttaactaatagtggatacgctttcaaggatttgttcacaaactttcaattttcataacattgcaaacttaattatcggcatattatttctttcataaggcgaaattagcctataatatagttaatagaaagcgaggcgatcatgatgaaaaaaacgtttacttggtccgtcagtaacggctttgctgtcctcctcctgaccgtggggacaattcttgctatcatcactcttggtattagctttggttcaccaatcagtgtcgacgccatggtcacagcagcggctctgtggctagccggtgtcgtcttcttacatccagcccctgtgagaattctaattcccgtcatcacattagtcagtctcagccttggttacgccacctactttagcacgtccggttcatggttgcttgcgattttagcgaccattatcacagccggcatcatcagctacggttttagtctccgtaagacgattcgccaacaccacagccattggtacgattaatttcctagtctgattcattttcttctaaatcaaaatcgccaatctaaacatcgcaacgggcatcggcgcccttatcgcgatgcttttttatttagctttcaatccagattgttaacccgtatcagtttttcaaaggcaaaagtgaccagctaagattcgctggaaaaaattcggaatagcatgcacccgtctggctagttcgtcctacattgactcccaggcattttcgccaattgctggaacacgacgagcccagattcaagccgccgaagcccacgtcttaaatactggtctgccacagcttagccatcatttaaggccacatcacagagccccgcccggcatcatcaatcaacagcagacaaacacgaacagatgttttataataggaagcgactaaattcagaagggatgctccgatggcaactaagattggaattcgacaattggtagaattcgtcttgcgacaaggcgatttaaatgaagtaaagaatagccagaacactgcgttgaacggtgctaagattcatcgtcagctccagagtagtcgtggtgaagactatgatagcgaagtttacctgaaaaaaattgtgacgatgaacgatactgattacattatcgcgggtcgggcagacgggattcagttaaatgatgatggggcgttgattgaagaaatcaaaacatccgatcaagtcttcgaggacttaagtaccaacacgttgacactttactgggggcagatcaaagtctacggttacctgttactgcaagaacatcccgatcttgagcaggtcacgttgcagctgacctactttcaagtcatcaatgaaaaaatcacgaagacccagcaaatccttcaccgggctgaactagacgcattcttccacgacttaattacagaatatgaatactggttgacattacgagccgatttacgacgacaacgaaacgcttctattgaagacttgccatttccgtttccagcttttcgaccgggccaacatgaattggctggcgctgtttataagacaattcggttgcaaaaacgcctctttgtcgaagcaccaactgggacggggaaaacgatctcaacgctatttccggctatcaaagcaatgggcgaagacgtgattgagcgcctcttttacctgaccgctaagcaaagtacgcgccacgttgctgaagaagcggtcacgctaatgagtcatgacggactcaaactgaaaagcattacgctaactgccaaggatcagattcgttttcccgaggaacaagatgtacttccggaagataatccttatatgattgggtactacgaccgacttaaaccagcactcaaggatctgttgacccatgaagaccagattacccgttccgtgattgaacagtatgctcgcaagcatactgtcgatccgtttgaattttcactcgacacgtcgctcttctgtgatgtgattatttgtgactacaactatctttttgacccattagtctatttacaacggttctttagcgaacgtgatgacgacaactttttccttgtcgatgaagtccacaaccttgttagtcgctcccgtgatatgtactctgcagccgttagtgaccagccaatcagtgcgttgctaaaattagccaagcccgataaaagtcagccaagtgacgacttacaacgcgaactcaagaaagtccggcgtagttttacgcgcatcagtaaaaccttgattgatgaccaagtaacggaacaggtgctacctgatcccccggacaaattattacgcaccctcagaacatttaatgaatttgtgactgactggttggcgcaacaaaagccggggccactgctcgacgccgtccgtgactatttcttcgcctgtctgacctttgttaaaattggcgacctatatgatggcagctaccagacgcgcttcgtccttgacggtcatcacttaacgatcaaggaactctgcctagatcccagtgactttcttaatcggtcattagagctcggcagtggtgctgtcctattttctgcgacgctgaccccgatggcttactaccagcgggtgcttggcggtgaagccaacagtttggcctaccagcttccatcaccatttccaccaaagcatcaggccattctcgccacccagtacgtccagacaacgtatcacgaacgcgaacataacgtgccccggattattgccagcttgcacgccatgttgacggctaaacgtggcaactacctcgtgttctttccgtcgtatggctatctgttgcagatcaaaactgcctttgaagccgactaccctgatgtggcaactaccgcccaagcctcgacgatggatgcaactgcccggcagacctttttgaaccagtttcagtcagcaccctcgcaaaccttactcggtttctgcgtactgggtggtatcttctccgaaggcattgacttacgtggcgaccgtttgattggagtcgctatcgttagtgtcggtctgccggggatcaaccctgaaacgaacttgattcgtgactactacgaccatcaaaacggcttaggattcgcctacgcttaccaactgccaggcatgaacaacgtcttacaggctgctggccgcctgatccgcagtgccaaggacaccggaatcgttctcttgttagaccaacgcttcgctagtcggcgctacacagatttatttccagcacattggcagtactatcagacgatccaatcagtcccgcagctcgaagcaacgattgccaacttttggcaccaaatggaggtgactcattaatgaagactaaattaactaaacaacttgaaagtaccctctatcagtactgtctagaacagggcgcctacgtggttgaagaagttgcgatgcccgctgataaagggatcgttgatacattaagctatcaacaactccccgatggccagattgaatggcgttgctacgaattgaaagtcaccaaagcagattttcattcaaaggccaaactgtcatttatcggtcattacaattactttgtcttgccgcaacagctttacctagaagttcaatcggaaattccagaccatattggtgtattgatctaccgtgcttttgatcagcgggccctagagctcgcaccccaaccgttgcgaacgcctggtttcctaactgtcgctaagaaagcccaacgccaagacttacaagtcgagcaaacgccccttatcagtcactttatcacatcgctctttcgtgaggtcgataaagccaagcgtgtgaagaaaggactacagctctactctgatgaccaactcttcaaagaattacgcaaacgagcccgcaccggctacgacgtttatgatcctgaacaaaacttgtacgatcgcttcatcgatgacacccagaatgacgcggtgactgcgctacaaacagaattagatgctcgcaatgctgaatatcaggcactcaaactaaaatatcaggcgctaacggcaccagatctgcgtgaccagttatgagcacttactacccctatctacgtggacggatgtatgatttgttagccttaaaaacattgtgcgagcaacaccaacttggcccacacatcatcccagtaattgaaccagtccgtgactccaaagaattacaacagacagtcacgacttttattgaagcccaacaaccatttagcattattgcgaatccccaagtgagcgtctatggtcttaataccgttaagctccatccacttccggatctgcgtccctacccattttaccggccgggcgcaattcttgcggctgattttagtcgcgactttctgacaaccagtcctggtcaaacaagcttgctcatcgcgcctaactatccgttgcttaaggcctatcagcatacgaccactttacagcatgctggtcatgtcctaatccctgatgaagcgcgtttgcaccaactattaccacaacacgcggtcttattgactgatcccgtggcaaccccagcgcacgttgcggactatcaagaaataactgacgcctattttgcccccgctaactggcaccaaacaccggttggctttgatggttttggcgattactcactcatgggccgaccctactttgaccacggtatgccatcacgcgcaattgcattacatcttatttatgttacggttaacggtgacctgcgcatccatcattttgtttcggacagcaatgccaatatgcgtggtcaaaagcaaaagttttttgaagcattaacaaagctcaccgactgggcacccgcacacctgacgggactcaatcgcacccccgcgcttgccaccctattggcctacgctgagggtgataaattcccagggttaggaataattaagaaattagcaatcatgcaccactttcaattgatgcaccgactactagcactgaattgaggagaaatgatggcaaaacaagaatctgcttggaaacaaatgatccatttctatcgtcatgattacgaagagcaacatgctccgatgttatacggcgacgtttggctgaagaccaaatcacatgaccggcttctactagggttaagtgaccaaggacagcacaatctgggtgtcgttcatcaacttgctttaccaactaagggccagcacctcgtggcaggtgatccgctcgtcacgattacggacgagcacggggcgcatccggtgccaacaccctttagtggtaccgttcagaagcttaacgaagacctacaagcggcaccccaatcgctcattaacaataagcaaaccgacaattggctggtccaattaaaggccgactaacttcgagttaccaaaagtaagttagcttatgtttgaataagcgcttacatttccaccaaaacgactcgtaaattgacttaaccaagcttagccacgacatcaacggttgccgatcccagcaatatcaagctccgaacttatatagtcgtgtttgattatgttaaccaacagacaccgtcttcatttgtaaacagccttgattgacacgctcagaaacaattgcaccgcgcgttatattacaaaagattacaaaatacgccgtttattacaagaattagggtaattcgtaaaactcctgctattttcctgtcacaatcgccagttatactaggtaccattgagtgcttggaagattcgcggggccaagccaaattcggactaaaaaataggagtgtacattacaaatgaagattaagaatgctttattatcaactgctgccgctactgctagtctctttgccattggtgctaccgctcaagctgctacggtaactgttaaggccggtgacacggtttctgccattgctgctgaccacaacacgacgattgatgcgatccaacaagctaaccacttaaaagacgttaacttgatcttagttggtcaacaacttgaagtaaatggtgatagcactaccacgacttcaacacagacgacgcaacaaacgactacgacacaatcatcaactcagactagtcaaacgcaagctcaatcgaaccaagctagccagacccaatcaagtcaaacacaaactagcaaacctgctgctcagacgacgactcaaacgtctagttcaacatcaaactacagcaacaatggttctgatagtgctgctaaggcttggattgctggtaaagaatctggtggttcatattctgctcgtaacggtcaatacatcggtaagtaccaattaagtgcttcatacttaaacggtgactactccgctgccaaccaagaacgtgttgctaacagttatgttgcttcacgttatggctcatggagcaacgccaagagtcactggcttgctaatggctggtactaagaagccactctaaattaataaacaaatgcaaagattgtggatcatttctgattcgcaatctttttttctactattaaatccgtgctgaagcacgtgtgtcccccaccaatacccattataaagttactcagttgctaagtgactttataataggccttagcacttagcatgctgacaacccgttatttagatatgcgatatgcttattctggcaaccgctttaatacggacacaatccagacctgctagttgtctcccccaatcgacgacccactctcccaaccaaaataccacatgtttttatttaacaattcactaaccttaacggagaaaatccaactaatttcctgactaagtacagtcccgaacccccgacagtttgacgactagtccacaacgacaaccacataccattcagctatggcgtaatactaacccagtaacgttttagtagcgatcgtcatgggctacttttggcataaagctactatagtaatacttaattaatcgacgccttcgttaaccgaccacaattgacgacacgatgcgcaacttctatcaattatctgctttaccgaaaaataattagtcagtaccacgtcgccaagcaataaaatgactagttaagtgtcactgtaatcagacctcccgacaaattaacccgtcaaaattcactagttaagtgcttaaaattatcgataatcctcgttgacttttcataaatcgacccaaagtgatcacttttatcggataaagcggctaatttccatcattagttttcccgtttaatcattgtcgctattgattttctagctagttaatcgggattggtagcgctattttacatgaaatccggctcaaatattacaattcattacaaaaacggccttatattacaagcaccccccaaaaacgtaatgttctgattattgcactgcaacactcactagttatactagtcactgttgattggttgagacatcaactgctcgaccaatagaaaatatatgtaaataatcgaacacacgcaaattataggagagtgtattaattattatgaagatcaaaaaccttgtattatcatcaactgctgcattagctttattcgctatctcaacaacggttgccaacgctgatacttatactgttaaggccggcgatactgtttcagcaattgcccaagctcacaacacttcagtttcagccattgaaaaggcaaacaagttagctaatgttaacttaatcttcattggtgataagcttgaagtcaatggtactactacaacaaccacgacttctgctgctacaagtgctgcaccacaatcagcaactagccaagctacttcttcagctgcttcaactgcaacgagtgccagtgctactagtgcttcttcacaatcagttgctagccaagctactagttctgctgctacttcttcagctgctagccaagctacttcaagtgttgcaacgagtgctgcttcttcagcaagctcaacgcaatcagctgctagccaagcttcaagttctgctgcaaccactagtcaagcttcatcaagcgctactagctcagctgcatcatcaacaacctcaacgacttcaagctacactggtagtaacttaaagagctacgtattaagccaaatgcaatcacggactggcgtttcagcttcaacttggaacacgatcatcacgcgtgaatcaaactggaacactacggtcaagaacagtacttctggtgcctatggtttattccaaaacatgcacatcagcagtggctctgttgaagaccaagttaacgctgccgttagcttatacaacgcacaaggcatggctgcttgggctttataaaataactgattactaacgaacagcgtaatgacattaattgtcgttacgctgtttttttatgctcagattcatttaaaaggcgtatgcttagtagcgagaatacgaggaaggatctgaagagatgcgccacgaaaccaaattagtcatcacactatggggtggcatgttaggcagtatgttgttgattggcctgatttttcagctaccacgcttaacccaactcccatcctcattaacaactggggtcgaagagctgttctttttagcaattgcactcatattaaatcgtgactggctacggcaaaccttaaaatttggggtatcggcaacttggcgtcggcaaatccggcccatcattccaaccttaatcgtagccgcactaattggattatatacgttagcaaccgcccaacaactgacaaacaccctgaccctgttattcgttgccatattgatcagcctgttcgaagagaccttttttcgcggaatgttgtttcaggccagccagtcaacattgggtgtaggtagagctgcagtcttcactagtatcctcttcagtttgacccatctaatcaatcttggtcaccaaacacttagtttaaccctattgcaattgggctttacgttcgtactggggctactattatgtttaatcacggcacagacaacatcgctactatggccattgttgattcacaccgtcaatgacttctttagcatgatggcacctccaatcaatttgcccggtataacgacgactagttttcaaatcatcgaaatcgcggtcattatcctattaatactgccgattctacgccaaaatcaccagtggctgtcataatgaccaccagcaactaatcgattcgtaattaatataaccaacaccttcaatgtgacctatactaaagttagcattaacttctggaggggatttcgatgtcatcaaccaaacgcggctggggagccgctattagtattttcattttagtaccaattctttttaaattaattgcctggctaccagtaccaactttatacagtgggctggtccaagacttgcttgtattacttattttcctgctattaaatcatttttggtttaaaatatcgattcagtggtggcaatcgcaatcactcgtacgacaatgcttgcagctcatcccgggaattattattttattactaccaatgacgagcaacttcatcaagctatgtcatcttgcttggaccccaacgttaattctctatattggctacgccctagttatcgggatcactgaggaatatatctatcggggcatgctcctgccactactacgacaatgcttccctcaccgactcatgctagccatttgtatcgacagtttactatttggtcttacccacctactcattaacagcagccagctgaccctcagctacgtcatcccacaagtcttttatgctgcagcgggtggcctgattttttgcggcctttatctacgaaccaataacttagtctggccgattttcttgcacgccttatcggacgtatccgtcgtcgttagtttggccacgcatacccacaccgcggccaagttgagtattccggttgcttacgcgattggcatctcggtgctctatctcgtcttgtttatcatcatcgcctttatcgttcgctggcaagttcgccctcaaaaccgattgttgtctcgttagcaattcacagtcattaaaaaatgagtccccagaatcaaatcattctgagaactcatttttagtgacttatcttgataagagtacgattgtacgcgtcaactcacgtctgattcaatcgtaagagcaccctaggtttccgccacaaatttgtgcttttctaatcggtaggagtggtcacaaacgtccgccacatccggttcatgcgtgacaataatgacgcacttcttttgttcatgcgcaattttttgaaattggtcaatcacatatttcgtattttcttcatccaaattaccggttggttcatccgcaaccactagtttagcatcgcacaccatggtccgtgcaatcgccacccgttgctgctgaccaccagataagcgttgaacattcttcttcatctgatcatctgtaatacctaaccgtcgtaacatcttcatcgcataatccttgtcaccacggtgttccgagttcgtaattgccatggcagtcatcagattattcaatggtgacatatacgtcaacaaattatatgattgaaaaacgattgctactttggacttccgatagttcgtcagaccaatcttattgattggttcaccattgagttcaatttgcccagcccgcggtttatctagacccgccagcagtgagaggaaggtcgtcttaccggaaccactttgaccaacaatggcatacgaagtccccgacttaaattcaaggtttacattctcaaatagactattttcttggcggtcataccagtaaccaagatcatttacttttaacattgccgcccctctcacaagcttttagattcaaatcaattggctacagcaccatataatagtaataggacacgaacacacagacgaccatacaaatcaagttcaacggaattccgactttaaagtagtccgtgaatttatagtgtccagggccgtatacgatcaagttcgtctgatagccgattggcgtcgaaaagtccgccgtcgccgcaatcgtaatcaacataacgagcatcatcacgggtaagtcctccaacttcgctgcggaaacaaccactggaaacatcaatgataacgccgccgcattggacaaaatagccgttaagaaattggtcacgaaataaatcaggaacatatagatgattggtgatgcgttcccggtaattgcgactaatgactttgcgataaacttatccgcacccacgttcgacatcgcaagcccgagtccatagctactagccaccaaaaacaacacgttcatatcaacagctttcacaatatcgctgattgaaacgcatttcgtcaagaaaagtaccacgcacgaggccgccagaccaacaaacaaatcaatcacgcccattgtcgacacgatgatcgttgcaaccaataaaacaatcggtaaaacatccttataagtatgtttccgggacttcactggttgtgaattaaagacgtgtaaatctttgagacttgccagctcgtctggttcaccagtggtaatcatgaccaagttgtccccgccttttaagcgaatacttccgagatgcccttcgaggttgacatcgttgcgtcgaattgcgacgacgacactcccaaagacattgcgaaaacgcgctgatttgaccgtttggttcaccaaactggacgtgtccggaatggagacttcgacgagccgaacccgttcattggtgatatcagtcatattgattttctgagtgcttggtattagacctttaatattcataagatcattaatacaatcaaaatttccagtgaagtaaagacggtcacctaactgtagaatcgtctcatccgtcaccggcacgatcgactgaccactccgattaatcgccactaagaaagagcgcggtaaattacgaagtttggcggcgaccaccgtttgattgaggtgttcaaactcatcgccgatcgtcatttcaatcaagtaatcattcggttcagcaacaacatcgtcaacactactcccataataggtcggtaacatgcggtacccgattgtcagtaagtaaatcaacccaataatcgtgatgggaaccccgatgacggccaagtcaaaggtaccaaattgtgctaatttgtacttagacaataatccttgtgccactagattggtcgaagtccctagaacggtcaacagcccactcagaatcgtggcataggatagtgggatcaagaactttgagattgccatccctttctgcttcgtccaacgctggaccatcggtgtcaaagtggacacaatcggggtattattcataaacggtgaaatcacactcacgctcgctaacaaccgtaataaggaacgcttttcgctgtgaccatcgccgagaatccggtcaaataagcgggtaataatattacttttggcaatggcataggcaataatatacatcagggcaattgtcgctaatccgtcgttagcaaaaccagacagtgcgtccgttggcgacaagatgccgacaaacatcaagaacgctaaggcacacaagattacggcgttcggggtcgtaacttccatggccattaatataaatgatactaataacgtgattaaaacaattgcaatatttaaggtcatcgtcatcgctccgcttcaactaattttcatctcgctgagtcttgcgccactgctcataatcagcctatatccgtcgcgccgttcaacataagaaccattgtagacttggaatgtgaacataaatgcgacacggtatgaaattattctagctttgcggatgattttgcgaccaaattgtgactttttcattaacattcagtcacaactttgcaaacgaccttttcgggctgacaactggtttaagaacggacgcgcttgaagtcgtgtggatgacgaaatattgattatcaagcattcaaaagtgacgcctagctagtcaaccggcaatcattatccgcagttattgatcaaccgatattatgactagtccgccattgagccatattttcataccgggctactaacgaccatcgcgccatcagtatcttggttagcgcaacacgcaaacaggcgcccccgaccagatgagccatctagtcatgagcgcccgttttacattcgataatccttattcattaataccatacgtgtgtttcgtcggatacaacgagaagcgttcggcccggtagacatagccaccgcttggaagccccgtcaattcaacgttaaacacctgttgtttgctcttcaaatcgtattccataatattagctgatttaccattattcaaccaaccaaaatcaattagtcgattcgaagcgctcaagtaacggttagaaccaataatattggcaaagttcttcttacctaatgacttaccatagctaccaacttgagaaatcgtcttcgtcttctcattgatgtgatattcgacaccttctgaatatttaccagaagagtccgccaacgatttcttggtcgtcccaactgccacgttattgttgaagatcatcacgttgagcgagttcttcttgcccaaggtgcttggatcaacgatggcggcatgttgcccacctggccaagcaatcttaccactagccttcagcaagtacttgcggtacgatttcggccaagctgaagtcttcttaccagacaagatccacttaatcttttcagtcttgtaatcgatcttcatcactaagttctggttgcgacttgaaataatcaagctcttatccgtcttatcataatagacggagttctgatggaaccagtccttcttacccatatatttactggacttcgtcgcgttgtacttcgtatagaacttcgcaggtaggatattcttcatgttgatgaccttggtaatcttacccgtcttatgcgatataacgatcatcgtgtcttcgacataggtccggccgccatcggaaacggtcgcaatcagatcaccgtttggcaattccgttacgtcatggtggacctgattatggttctgcttcttagaacccttagccttaccccaggccttatgattaaatttataagtcttataaactttacccgtataatccatttcaactaactcatcaaaatatgaattcttaacattcgatttggtccaaatcaataaatgcccattgttaagttgtttgaaaatgtgggaagttggccgcgttgtataccaccgaatattaccatccgcatccatcccgaacgataagtttttagactgcttgctcccagagatcgtcgtccgaaccataaatgtcagcttcgaattaccagtccctaagaccattttttgtttgttagccttcttaacgttgatcttaaaatcggtcaacgccgatggtaacttcgccgttttcagtcggatcgtcttggtcgtcgacgtgccatccttataagtcaccttaatcttgacctggttattcgcgttggcgtataaccccagcacggtcaaatcatgactcgttgtgtacttattgaccgtattagaaattgaagtcttactactcttgccgaccaccgtataactgaccttggccgccttgctcgtctggaaaatcaccttagcggataacggagacaccccatatgggttaaccttcgtgtacatgttattaatggtataattcttattggcgaccgccttcttcagcgtcgccgtctcactcgactgggccttaatctcagtcttgactagccgcgtgttgatgtccttcttcgttgcactcgccgaacgtaccttactagtggtcgttgtcgttgcagttgactgatgatatttgtaatacccaaaaccaccgccaatcgcgacaatcacaacgacaattagtgcaatcaaccaatttcgctttttcatttacctttcaccgaccctatctcactattttttctgacgccaattaattcctcacgactgctactccaacggaatgcccattttgtcagccagaatattaggctcacgccgctgatactggcggtctaaccttcccgtggcaacccacgtgaccgacacagaatgactaacaattgccatgccgaaccgaatcagttcagtttatattaaatttattatacttaatctactgccgtcgcagccaatacttgcgcctgcatttgctcaatgacttgtccaactgtcactaaatccgggacaaatgccccacttgctaacggatgaccaccgccattgaacgcttttgcgactgcattgacattgattgctttcgaccgaaaatgtacgcggtattgcccctgtggggtttcaatgaagaacaaccaaactttgaccgtcgtcaggttaccgggcaacgggacaagcgcatcctcatcgccatattccagactcaagtcactaaatatccgttgtggtaagacaacgtgtgccagaccacttggctcaatagtttgttcactcaggacgtacccatacaacttgctgagtgctggcgttaagtccatttcgtggtgactaatagtggcaatatcaatgtccgttgccgcgagtgcactagcaatcttcagagttcgagtggacgtctcgggagttgaaaagcgcaccgtatcgccgataattccggcatatagcttggttgcaacggccgccgtcactgtaaagcaccccgcttgcgccaactcataaatcatctccgagcaactgctataagtttcatcgacccagttcagttgcccatagggatcgtgattcgggtgatggtcgattttaatcacaaaggcacctgttggcaactccccagctaggcgctcatggttagcacaatctacggcaatgactaagtccgttgcttggggggtcactaactgctcatcggttgtatcgatccacgccaaatggcccggaactggggccatcgccacaacaagtttctccgggtaagccgctttgagcaaggcgactagtccaaattgtgccccgattgcatcgggatccggattcgtatgacgatagaccaagattcggtccattttcacaatcgattttgtgatggcagtaatgattgcactagttttcatttgcagtaaccaaactgacgtaatggtgttccgctaagtaattcaatacttgttgcacggaagcggccagtggctgtttagacgtgtcaatcgtaatctcaggatcgataggtgcttcgtatggtgcatcgatgcctgtaaagcccgtgatttcaccacgacgcgccttcgcgtacaattgtttcacatctcgttgttcacaaacttcaagcggcgtgtcgacgaacacttcaataaactcatcggcctccaggttcgcccgcactttatcacggtcggcccgatatggcgaaatgaaagccgtcaacgtaatcacaccagcatcgacaaatagtttggcaacttcaccgattcgacgaatattctcttcacggtcttccgctgaaaatcctaaattcttattcaagccaaaacgcatattgtcgccgtctaagacgtaactaccaatttgttggtcaaatagtgctttttcaacggcattcgcgattgtcgacttaccagagccagacaggcccgtaaaccataaaacgacactcttgtgatggttcagcgcttgccgttcagctttgctaacttgcgaatggtgccaagtaatattatctgactttaccatgcttagacctcctgttgctgttcacgtttgcgcttcaacccgtcgatgaggacccgggctacttcgggacgtgagacttcctttggtggtacgacaccatcagccagcatcttacgaacctttgtcccactcaatgagatgtgatcttcagcaccgtgtgggcacgtcttctgcgttgccattgatccacacttcttgcagtagaaggaattatcgaatttgaagaagtgcatccccatctcgtcttcgaccgaactgattagttcttgggcttcataggtcccgtaatagtcacccacaccagcatggtcacgaccgacgataaagtcagtacagccatagtttttacgaacgattgcgtgtaagatggcttccttaggaccagcgtaacgcatcgcggctggataaatgaccaaccgaacacggtcctctggatagtaatatttcagaatcgtcttatagctttccatccgaacatctgctggaatatcatccgccttggtctcaccaaccagtggatttaagaataagccatcgacgttttccaaagctaatttttgaatatattcatgcgcccggtgaattgggttccgcgtctggaacccaacgatccgcttccagccgaggtcatggaacatcttccgagtttctagtggttccatgtaataatcactaaaggcaccatgatctggcttatgcaacaatttaattgcaccacccaagtagacgtcaccattggcatataagcgtttgacaccgggatgggcttcgtcggtggtcttgtagacgttttgggcttccaattgcttgtccggaacaaacttatcttcaacttgcatcgtgccataaatgacaccgtcagctcccttcaaagcaatctcagtgttcaattcaatcttatcagcatccgctttagacacgcccaatgtgattggcacactccagataacaccactcttcaagtgcatcgtgttgaccactgaatggtaatcatcactgaccatgaaaccagtcagggggctaaaaccaccaatcccaattaattccaagtccgagatattccaattattgatagttaaacttggcagctgctcagcagcttgacgcgttgcttcactaaaatcttctaaattaactaacttaccaccatgagctttaattccgtacactgtttgcatattgatcacctttcacgtttaaaatttcttcataattaagacttacaaaatggttcaatgcggcttgctgttgttcatcctgacttgcacgtcgacacaacgccgttaacgttgccgccacctcatccatgtctagtggggtccgtagcttgaacgtctcgtccggctgttcgtctcgtaacggtgctaccttagttggttcagcggcaataaaagccgccaccgcactttgcgattcaggggttccaagttcgtcagccatcaggaccaagtatgggggctgctcaaccgcgtgcaatgtccgtattaaatgttgaatcgctaatcgacgctcacgttcatcagtgatagccgttaagtcatctgcaatcaccacattatgcgtgtccgcacctaactcggcactgaccgtcgttaacatttcaacgatttcattgtttttagcatcgccaatcccccacaacgtctcgcgttttgcgtttttacggagataattattcaaggcttccttttgctcgaccactaaatagtccaaggggtacgtctgaatggcgatcgtattattattcaatcgttcgctcaaatcttcggcaatctcatgactgtcagcttctgtgccgaccatcttgacttgaccgtttcgtaaaatcgtgttgacctgatcaacctgggcctgattttcgccgaatacaaagaacgttttactattgatcttgacgttaaagtcccggtataaagcaccgtacttagctaaatactcgtcagtcatttcgtcgatgcgctgttgaaattcagccgaggcaaagtaatcggggtcagccgcagcttgacggcctagtaagtaaagtgccttaacatcgggttccacgtccgttcgagcttcaaaatcagctaaattttcaccgctatcactcttttggagtgctggatcgatgaagtcatcgatttgcgcttggagggccgcctcgtcgctcgtccacggtaagttaaattgggtcgcgattcgtttcaacgtcgtcaacgtctgaccaaacaaatcttcgtacgtgactaaaatacggtgctcacggtcggtatcacgtaatgaaagcaacgtccggacttgccactgacgcattgcgagcgtggtatcacggcgccaggcgcgctcattcgaattgaccacgtccatcggattacgtagcaagacgatttcagccggctgaacctcaacgtcagccaaaacacgttgccacaattcgatataatcattcatccgtgggtctttaatcgccagatactgttcattctcaaaaaagtttcgtagatacgtggttaacgccgcccggtcctttttaatcttcgggctatcgtagtaacccttgaaggctggccggtaccggatgcgacttccaagtgacttgtgaatattgatgacatccttgttttcaaaatagcctttcggattgattcgcttactaggtgccagcaagttatcagttccgagagaaatgcccatcaaattaacacacttggtcattaccgacgtccccgaacgaccacttccaagaattaatacggcctgtttcgttggttgacggtgattaaataatcgttgccataagctttgactcattcttcatcatcctaatcattattatttatttgatctttggtacttcgctagtgggctcaacaaatatactagcaagttaattgtgaaaataagtacccttaactcgaaaaaaatatgatgatttcatgaaatttagtgcttttagcaagtacgcacccggtaatctgctgggtgtagattaggacatttccccatagttttgatgaaatattcaaattttaggactattaaaatccctttacaccagtgcattgattaccaaagcacctgatttcactaagtatcgtcagcacccttaaccaacttaatcctcaattgaatgcttggcgcaacacccctgttatgaaggcctaaaatgtcaacccaaccatgtgggagctgcgtttcaaccctattcaccagctcaagtggtcgaaatccgacaacggttgctggcaaagactagtggctgttcacactacgtttcctacttgcctggctccaaatagcgtgtgcgtcacattacgccttgaatatgttcaaaagattaaaaaataatttgactaaattagaaattggtggtattttctgatcaatcataaaacatgtaaacgtcctgaagaggaaagtaatcatcgctacccgtgcagtgagtttggaatagtgcaaaccaaaccggaagacgattgatgaaaaatggcctccaaacggcaccactgagcttttgccaggtgatgacagttagctactgttaataagcttccgtatgaaacgtacggattgaggtcaatatcgtgaggtgttgacaaattaaggtggtaccgcgaacggcaacttcgtcctttaatcaggatgaggttgccgttttttcgtttaaataaatttgctaaatataaggagtgggtttaaatgacaattattaatagtaacttggggtatccgcgtttaggggaacatcgtgaatggaagcacttattggaacacttttggaagggtcaattagataacgtgacctttcacgccactgctaaaaaattacgcttagctaacttgaaaaagcaacgcgacctgggcgtggactatattccagtcgctgacaattcggattacgatcacgttttagatacactagtcgcattcaacgcgattccaacgcgctttggtcacttcgatcaccagttggacttgcccgactactatgcaattgcccgtggaactgataccgccgtggcggccgaaatgaccaagtggttcaatatcaactatcactacatcgtgcctgaattcgatgatgtgtccttcaagttattagataaccgttggctacgttactaccaagaagctaagcaagaacttggcatcgatggtaaaccagtgattctgggccccgtctctttccttaagctggggaagcgtcacggacagtacttaaatgacgcggccgtcaacgaactattaccacaattattaccactttaccaacaagtgtttgaagaactagcgacagccggtgcaaaatggattcagttagatgaaccgaccctcgtcaaaacaacgacgactgcggaactcgcaccttatcaaactgcacttgaacatttgcatacggctgttccatccttaaaaatcgaactccaaacttatttcgacagtcttgatcagtatgaccaaatcgtgacctggccagtccaagcacttggactggacctcgtacacgaccatggtgaaaacttggcgcacttggtcgaccacggtttcccagctgacaaaattctcgcagctggcattattgatggacataacgtctgggctagtgatctacaagcaaaacttgcattagttcaacagttacggcaaatcgtgaccgctgatcagttatggctccaaccggccaactcattattacacgtcccgattaccaccaaaaacgaaaccaaggctgaccccgtcttactgggcggcctggcctttgcggaccagaaattggcagaactgcataccttaaccgtggcagccaatcaaggagttcccgctgttcaagcagcgtttgaccgtaatcagactaacttgaccgctctcaaccagtccagtcaccgcaacaaccagtcggtccgcgccgctgaagcgcaactgagtaatcaaaaattcgaacgccaggcgccatttgcgacccggattaagttacaacacgaccggttacacctgcccctcctgccaacaacaacgattgggagctttccgcaaagtgcgcaagtccgagcaaaacgagcagcatggcgcaagggtaatttaaccgatgccgattaccaggcattcctgcatgctgaaaccaaacgatggatcaagctgcaagaagacctcggcctcgacgtcctggttcacggtgaatttgaacgcactgacatggtcgagtactttggtcaaaaactgactggcttctatgcgacccaaaatggttgggtccaatcatacggttcacgaggcgtccggccacccgttatctttggggatgtcgcttacacggaaccaatcaccgttgctgagtccgtttacgcgcaaagtttaaccgaccagccagtcaaaggcatgttgacggcgcctttgaccattatcaactggagttttgttcgcgacgatatccctagggcgcaggttcaaaatcagattgctttggccctccggcaagaagttcaaaacttggaaaaagctggtattaagattattcaagttgatgaaccagcacttagggaaggtttaccactcaagcagcgccattggcaagcctatttggatgaagcagtgtactcatttaagatcaccacgaccggcgtgcaaaacgacactcagattcatacccatatgtgctactctaactttgccgatatcatcgataccatcaaagcccttgacgcagatgtcatttcgattgaaacgtcccgtagccatggggaaattatcagtgcttttgaacaaaccgggtacgatcaagaaatcggtctgggggtctatgacattcacagtccacgcgtaccgagtgttgcggaaattgaagccaacatccaacgcgcattacgcgttatcgacgcccggcaattctggatcaatcctgactgtggtctcaaaacccggcaagaatcagaaaccctagcagccttaaagaacatgattgctgcgcgcaacgcgatccaggcccaactgaccactagcatccactaaggaggtggcttgaatgaagtttaaacaagcactccagcaacgggtcctcgttgccgatggcgcaatgggcacccttttatatggtaattatggcatcaattcggcttttgaaaacctgaatttgacgcatcccgacacgatcttacgcgttcaccgatcgtacattcgggctggtgccgatattattcaaaccaacacctacgctgcgaaccgcctaaagttgacccggtatgatttacaagaccaagtcaccaccatcaatcaggccgctgtgaaaattgcagcgaccgcacgggaacacgcggatcaccccgtttacattctgggaacgattggtggactagccggcgataccgatgcaactgttcaacgggcgacaccagcaacgattgctgccagcgtgactgaacaacttaccgcccttctagccaccaaccagttagatggcatcttgctcgaaacatattatgatttgctagaactactcgccgcgttaaaaatcgtgaaagcccatactgacttgcccgtcatcacaaatgtttcaatgttagcccccggcgtcttacgaaacggtatgagcttcactgatgccatcgtccaactcaacgctgccggcgccgacgtaatcggcacgaactgtcgcctgggaccttactatttagctcagtcatttgaaaacttggcgattccagctaacgtcaaactagccgtttacccaaacgctggcttgcctggcactgatcaggacggtgcggtggtctacgatggtgaaccaagctatttcgaagaatatgccgaacgctttcgtcagctcggtctgaacattattggtggttgttgtgggaccacacctttgcataccagcgcaaccgtccgcggtctaagtaatcgcagcatcgttgctcatgaccagccggctacaaaaccacagccaccaacgctcgtcacgacaaagagtcagcaccggtttctgcaaaaagttgcgacccaaaaaacggcgttagtcgaactcgatccaccccgcgattttgatacgactaaatttttccggggtgctgaacgattaaaagccgctggtgtcgatggcattacactgtctgacaattcgttagcaacggtccggattgctaatacgacgattgcggcgcagctcaagttgaactacggcatcacgccgatcgttcacttgacgacccgcgaccacaatctaatcggcttacaatcagagatcatgggtctacacagcctaggtattgaggacatcttagctatcactggcgatccggccaaactcggtgattttccgggagccacttcggtcagcgatgtgcgctccgttgaactgatgaagttgatcaagcaattcaatagcggcatcggaccaacgggtaagtcgcttaaagaagccagtgactttcgggtcgcaggcgcctttaatcctaacgcttatcgcacttccatatcgaccaagtcaatcagtcggaagttaagttatggttgtgactacattatcacccaacccgtgtatgatcttgcaaatgttgacgctttggcggatgctctagcggctaatcacgtgaatgtgccagtgttcgttggtgttatgccactcgtctcacggcgtaatgctgaattcctacaccatgaagtccatggcattcggattccagagcctatcttgacgcgcatggcagaagccgaacagaccggaaacgaacgggcagtgggcattgctattgcaaaggaattgattgatggtatctgtgcgcgcttcaacggcgttcacatcgtcacaccgtttaaccgctttaaaacggtcattgaattagtcgattacatccaacagaaaaacttaattaaagtacaataaaagaaaccgccgccaacacctactttcatgctaaaattagacatgaattgtaaatgtggaggcggttttgtcatgtacttattagggcacattattggttggctatggctcatgctgacggttgcgattggtctcagtcgtcactcagtcaaatcagccaatcgctttttaattcttactcgtatcgggtacctgctgattatcatcactggagtggctttggcaatcagaaccttatcaggcaactggtggttgaccttgctaaaagtgatactcggtcttggcacgattggcctcattgaagtggcctttgcccgcaagcaggaaagtcatttgaattctggacttgtcaccctactcgtctgcggcaccttactaacgattatttgtggcatcggcttgcactggcaattgacgggaaacttgatttaaaccatcaatgtcgttgaaattactgcctaacgatccaaagtgatgctatcaaaaaagcaagtcgtccgttaggggacgacttgcttgcctgatgccaattaattgttacgatcactcaatcgtttcatgatttgctggcgcattcgcattttctggttgctttccataaaaatcagccgcgacgtcccatagttaaagagtcccacgagaacctgatcgatgattttaacaagtaggggtgcccagaacaacaacgaaatgccgacgaacatgaggaaagtatcgaaaaaatatgataagcctcgtgtcaacatgaaactaatgaactcgcgacaccaatgccaaaagtcttgcgatttggactgaaagaccaccgctttgttggtaaaaaaactaaacaaagttgctagcacccatgcgattgtgttggaaaataaatagtgttccgccaagactgagtgtagcacccagaataccaagacgttcaccagcgcggccataaagccaaacagtgcgtatttccaaaaatattgatattgatggtagattttaatcaaccactgcacgccgttcgccaccgtttcttctagctcaaaaatattatacaatagcaatatcataccttgttatcggccccctgacaagctcagccgttaaattggcgcttagtgggctggtcgcttatacttaaactaatctgcaattctttttggagtgaattatttatgagaacttatttatttattgccgggctgatcttagcctgtctaattttaatcattatcttaattgcggtgttagtccatctccaccatgtcaatcaggcggcggataaacaggccgcgttgcttaaatcaattcggcagcgcctcgttcatcaaactttgaccaatcaggaacaagaccgtcaaattaccaagttgcagactcaaaataacggttttcggaatcgcttgaatcaagccgttccccatccggtggcggttcctcagacgcgccggatcaacgctaattcgcgtgcaattttccgctcatacgtcattggtttagattactaccaaaaagaatttgaagccgcgctggccgatgcgagtgcccgaggttactttaaaccttatggtggctataatgattctggtctgaaagcagattatctctatgccaagaagtaccgtgtcgacgctaacgctaacatcggtgaaattcagttagttgaagaagttgatggtgctgagcgatccgtacgggttgaactaaaagttgcggagcatggctataccatcggctatctgccgaaaaagcaggtcgacgaagccttcaacgtgatcgacatttacgccaactcggtcatgaccctctcctccaaaactaatttaactggtggtgaatggaagatggcgatcgatgctgtcgatgaaatgcagtacctgaatgatcccaacgctcaaaatcgggcccttcccgattacggtgccattgacacccccttaaaaatcaagaccggtaagaagtcctacttcctccaattcaccttatatgaaatggaaatcagcaatgatgagattccattgtatagtttagtcgacaccgtcgacggtcaacgtggctcgattgttgaagttgatgctggtccgatctcatatgtgatcgacgtccaagctgggccacagactgggtccaagattacggtcattcctgaacaaatcgaccgtgtcatctgggttcctaactggaaataggtcaatcaccgttatcaagtgaggttattttaatgaaaaaattaatcttagtggtcctgttacttttgtcaatcggtgtgatgaccatcgttgattcgaacatcatccgacaagccccctatccgagcttgtcccaggaacaaacgaaataaggaggtccaaacgtgacccgggcaattttaatcagtttctgcgccctattccttttagcaggctgcacctcccaagctgagccaagtatttccactaagcaagcgaactcagttgcagccgctaaccgcgcggagcaaactagtcgtgccaatgcggcggctgatgccagtgctaagaagcaagctggtgaccattatcaagccactgacgaccatattactagtgcaactagtgcggtagccgccgtcggacaagtactcaacgaccccaagcaacaaacctttggcgtcgtacccaccgccaataaagatgcgcacggccaccattattatcaggtcgatgcttatcagaaaacgactaacggcggtcgggggcattatctgaatagttactttgtttatttagatgggagtatcacgaccaaacaggcgaattaataaacagacaagttgtcacccattcgagcagcgtcgttgaagctgctgggatgggtgactttttggatgcattttttgccggcaatcatttcagtgtttgggcgtacagttattccatgctaattaaggccagccccagtaactaagcaaccaatttgcaattacaattaatatcaactgcataaatatagaaaaaggtttatttttttgttacttttcgctataatggatattgttgttaaagcaactgccccagtggcggaactggcagacgcgcagcgttcaggtcgctgtattggaaacaatgtacaggttcgaatcctgcctggggcataaatagtctatgagcaataaaagagccacggtaaacacttatttactgggctcttttattttgtggattttaacaaagtagtgactttgcaaaggtttttacgcctttcttcaataaggatgaaattaaaataattttgctcaaccgatcagcgctggtccacctcacctatccgtttagacacactaaccacagcaaacgggccgtcgctcccattgttaggggaactatggccttttactaacggttaagtcattattgatcacagtggaaccatcaccaacacttcagaaactgaggcgattaatttctgaaaatccccaaaaagtcctatgcaacccacgattttagtgtatactagatatgttgacgaaaagttaacgtgatggcggtagtggcgaagtggttaacgcaccggattgtggctccggcacgcgtgggttcgattcccacctaccgcccttctaaaaaagcacgtgcaattgcacgtgctttttatttaatcaaatttttctaatcacgccgtcagccaagccttcaaagcggccccagtgcgtgaagtgggcacgtcaactgctgctcgtggggttccgctatactgaattcgaccgccatactgaccagcatccggccccacatcgatcaaccaatcggcctggctaattaccgccagattatgttcgataataatcaacgagttaccagcggccactaaggcatcgaataattttaataagcgttgtgtgtcttgcaaatgcagaccggcagtcggttcatctaacaagtacaccgttccctgcttgcctagctcaaccgccagcttcaaccgttgcagttcaccacccgacaaagtggtgagcggttgcgccaatgttaggtaacccaaaccgacccggtctaaattcttcaatggctgagccactttgtccatcgtggcaaaaaaagctaacgccgctgtgactgacatctggagcacgtcggcaatcgtcttaccctggtaagcatagctgagcgccgtttcattataccgcagcccatgacacaattcacatgtctgcacaacgggatccataaaggccatattcgtgatggtcacgcctttacccttacaccgcggacaagcacccttaccattatagctgaaccaactagttgccacgccattggctttcgcgaatagttgtcggatttgatcgagcactcctaagtaagtcgccggtgttgagcgaatattcaggcccactggtgtctgggctaaatcaatataagccgtctttaattgccgttttagcgcggtaaccagcgaactcttccctgaaccggccacccccgagacgaccgtcatcacaccgaggggcacgtcgacactgacatcgtgcaggttattttcattaatatggtgtaatgccaagtgggcctggactggtcgttcttgaccccatttatgcggttgtcgcaaccaccggcccgtcaacgtatcagaggccagtaactcgtcataagtcccggtaaaggtcacgtttccaccagtgcgaccagctgcaggccccatctcgacaacatagtcggctaacgtaaacatggctggattgtgttcaacaatcagaattgtgttacccttatccttcagctttgttaacgcttgcttgattaactgaatatcatgtgggtgcagcccaacgcttggctcgtctaaaatgtagaccatatctactaaggcgctggtcaagtatttggcaatcttaatccgttgcgcttcaccaccagataaagaactggtcccacgatccaatgtcagatagcccaggccaatatcgaccaacgattggatcttagtcgtcagctcccgcacaatatcttgggctagcggcgcatcaatcgcttgtagaaatgccagaacatgctttaaatccatagccgtcacctgagcaatgttgaccccgttaatatgattggtcaacacgaccggtttgagtcgtgtgccatcacacgttgggcacggtttgcgcgtgacgatcgccgcaatcgcatcgcgatggtgttcggcttccttcttaccgataatcgagcgcttgatccgcggaacaacgccttcatacagggccgttctaggaaacccttctccaggatgggctaatttttgttgcggtgcgtgcattagtaaatcgtattccgcagcactataatccttgatgggtttatcattgtcaaacaaaccactcgtcgcataacggcgccaacgccacgtatccggtgcaaaactcacaaacgtgatggccccctcgtttaatgatttctcaggatcaatcaattgctgctcatcaatatcgtcaacataacctaaaccttggcaggttgggcacatgccttggggtaagttaaacgaaaaactgtccgaatacccgataaacggttccccaacccgtgaaaacaagagccgcagtaacgaataaatcccagtataggttgccaaggttgaacgcgcattcttgccgaggcgttgttgagcaatcacaatcgcaacgggcaagtgctcgatatgcccgacgtgtggttgaccatacttcggtaaatattgttgcgtaaaactgggaaacgtttcattcagttcgcgccgtgacgccgctgcaatcgtatcaaaaacgagtgacgacttaccggaacctgacaagcccacgaacaccgtggttgcatatttaggaacgcgaagactaacgtgctttaaattgttttgggtagcgtcgtatacgtcaatggcgccatgtggaaatgaataactggtcatcaaaccttcctttctatcacttgtttgctatcaaaaaaggacctgaaaattcagatcctaagtatcagactgattcatcaacgagcttgacgaccgtcccatagccggttacgatcaaaaaccgtggtgcaacactcatctgagcgacttcagtattgaagttcacataaattaacccgtcgccaccttgatcctctgccttttgtagcagtagtggcttgacttgttcgattaaatcgtcaaaccgttcaaactgatcaacaccatcagattcaaacatcaggtgttttgtgacagagacgacgcccttaatcatatgggagcgctgtaaatcaccagttgtcataaacatttttccaaccccctatcactttaattttacttgaaaacgacgtcactcgcaaacgtaaccaattatttgaccacaagtttttaaaggactaaattaatcgtagggagtgatagtttgaaaacagcaacacaacttttacaacaatatacctttgagcccgttaaggataaaatgcgggtcgaacaacacgccttagccgtccaacatcaggatcgcgccattccattcggacacttcaagatccggttgaaaaatattgataatcaacaaacttatttattggaattaaagcaagcgttacagttgaccaccacgtctgggttccagttacgttcccgactacacggggtgcatgtcaaacatgcacaacacatgatgccgaccggttatcacgtattggcatcactgacgattaaggccgccccacgtgacgctcatgaatttgtacatgacaaaacaaaagtcgcctgcttgattccagttggtgatcacgcggccaaaacattgccagcacaagttccactttatgcgttcacggacaaccatcaacttgccatcaatcagcaggccatggcccagttattcctgacatgcattaagtcccaacaacgccaacaggtcaattaattaacccgcttttataaataaatcgttcgaaaacaatgtatttgcgcaatattaattgcatttggcgaattaattgcgtacaatgtactaaaacagatagtaaaggaggcggtttgatggcaaccccaacaaaaaacattttgctcgatgaacaactctgctttgcactttacaccgccagcaaacgatataatcatttttattccgaagctttagcaccctttaagctgacttatccgcagtacatcaccttattagcactgtgggaaaagagtccgatgacggtccgcgagcttggttcacacgttaacctcgatagtggaactctgaccccgttattgaaacggatgcaaacccaaggctgggttgaacgcaagcgcgatacggacgatgaacgccaagtcaacatctcattgtcgcaaaaagccatcgatgctaaaccggagatctttgcccacgttaattcttgcatggatttacttggtttagatgaagcaacctataaccagattcgcgaaacggtcaactttgcttctgaacacatcaaaaacgccgatcctaaaaaggtcgactacaccggtgaagcattctaaccagtcacctcactttggccgagattatcataatctcggcttttttgttgcgattaaaccgagtgattgccagtctacagcaccccctgcaccgtgcaaagctacggccagttcgcagcgcctaaataatcatggacggtctctttcaaaaataaagaaaataataaaactctagtggcacttgataatctagatagcaaaacataatttaagtatgtattagcgtgactccctcgtcagtctttcactttggagccggtgggacacttttggagcactttaaatcaaaaaaatgactctaccgccagaagcagtagggccaaagagttaggtttaagtacaatatgggggattgtacttgcttgtccatccactttgggggagtaaaatgaacaagtgtataactattaggtacaagtatatactattacataattgtgaagaaagtgtgaagatttcttcgaattgaccattttttattctttatttttataatacgccaatcgttttttttacaattattatatttcgggcacgtaactatattaatatccccactcaagacttacgtcacacgcttttatagatttgcaaatccgtgttgaaacctgagcactgcggtaaaatcaaccataggaggtgaagtcggatggaaataattgaccgcggtctggggtggctgggacgcgtactactcaccaccggtctaatcatcggcgtcgtgattccaccaatgttacttaagttaattaaccaattgtatcgccatcaccaactcatagcttggcaaataacactggcggtcgtttacttactgctttttatgatcctggccttagctgcaacggccataatgcgtcattacacgggtgaataccagtcgaaacagttacaacgccatgactggcaagttattggaacggcctatctcattatcttaatcttggagggcggcttgcaattaatcaatcagctcctatgtcaccagaaccagacacaaaataatgtcgctattaagaacttaatggccggcagtcccttgtcactgtggctcatggcattgagtgctgtttttttgaccccgatcgtcgaagaactgatttttcgcggcgtcctgacgaaccttttcttccaacaagaatggctcaaaattgggcttagcggcctggtcttcggtagcctgcacagtagctcgaccgttccaagctttctaatatacgtcaccatgggactggcactcgccgtagtctatcgtctgaccggaaagattcgtgccgccatcgcactccactttgtgattaacgccctcgcaatcaccatcatgttgctaaattgacgaaccacctctgcaactttgtggggacgcttgccagactaactcgtatagccgccttgccaaacaagtaggacgtcaaaaatcaagaacaacacattaaagtgtagcagccaccagttcattaggcccttctcacgcaccattcctgtgatggccaagccaataccgataaccggaatcaagcctccttggagcaaccggtaaatcggcaggtacgcccacttggacaacaatagcggccccgttagttgacctaataaaacaaacaataagaataccccgatattcagcaatgagcaggcaaacgccgtctcggtaacggtccccatcgcgaggcgaaagtgaaattggaatcgtaaaatcaatgtcccgatgattccaataaccaagataatgccaaccactaacatacagccacgactcctttttttgtcattgttactgtacgctaaaatcaaccacgcgcctagcacaaacccagaagcttaacgattttttagcaaacaccgtaactaggttagtgaccgggattctccaacccattcgctacggccgcaactggtcacatgggccgcgccacgtttgcaattatcaaaaaaagagccggcaacttgcccgctcacccaatctaactctttgtcccacttggtactgttagtactttggctttcaacccaacaactttaattgtgatccgcttatgaactggcatcttaacgtagaattgaccactctgcttgttcgaaataatctggcgaacgtgtttgccactcttgagcgtcacgataacgccgtgcttggtccgcccgctgattgtcgccgaggtggcattttgatggtataccacctttgacacggtgagccgatgggttcggcgatgataatcaccttgcaagctgtattccgaaccgaatattagcaaacaaccggccagaatcattaagattaatgaccagaactgtttcatgacaccacctccaccccagttcccacaactggtatttgataatattagcatacatgcaaattcatctggaaaaccaaaaaaggtgcaaagctcataatagcttgcaccaacgtcattaaaattcatttttgattaacggttttgttacactagagtcttgtgtggcactagctgaatgttaccgctagttcagaccgcttgaccaacgtcaccagatcatgcattttacgaatcgcaatatcgaccgactcgccattttcaaagtagccaagctgatgttgcttatcaattcgtactagcatttgcgggttcaccaagaaactcttatgaacccggaataactctgggtgggccacggtttcatcactaatcttaccattgtattgaacaattcgatctgttaaatggagaaccagcttattgcgaactgctccagtctcgataaataacacctgatctaatggaacattgaagagctgaccacccttagagtaagaaaacatggccttgctggtgactgcttgcttggtataacgttcataagcaacccgaatatctgtctccactttggctttgaccgtttcttgacccaaatctttcacaataaagtccagtggttcgattcgtcgttcaaaggtcaaaaaagccatttcagaatgggtcgacacgaagacaatccgcgcattaacatccgcctcgcgaattcgagtcgctagtgctaggccatttaagtcttgcccaggatattcaatatctaaaaagtagagtccctcaagatcggaattggtctcgacatagtccaacaacgtttgtgcttgtccggttgctaaggtcagttccatatcaaaatcattgatcataatatgattcttaatgatttgctttaaggttgctaattgttcaggatcgtcttccacaacaaaggtctttaacacgctgctcactcactttcaatactaataataaattcgaatcgttgatgggagctcacttcataagtcacgttcgctaacgggtctaacaactcgcggacggttgccaatccttgcccatggccagcacccttcgaggtatgtcccgcaaccatgagctcatctaagcgctcgatcgggtgattcaatgaattggcaaatattaattccaccatccgaggatacttgaccagtgccaccgtgatctgccccccactctggcccttcactgcttcgatggcattatctagcaagattccactcacccgtgatagcgtcaccggatcaattgcaatcactgaaatggggtcagtagcttccaagcgtacttgaatcccagcttggcgggcaacggaaaacttactttggacgattgccttcaatggcttatccttaatttgttccaagttgtcgaagtggccaaaatcacgattaagactctgcttcgacttggtcacgacttgccgaaagtattgctgtaattcaggatcatcggccgtttgaatgtattcgcctaaagataacagaatattctgataatcatggcggaacttacgtaaattttgataactactttctaaatttttgacataaatatcatattgttgccgctccaaagcttgccggttgctttgaacccgcagtgtgtaactatagaacaggtagaggaacgttccggcgttgatcagcaagattgccaccagaatcaacatcaggattcctaaaaatccagagccgatattatagttgtccgccgctgccgtgatggtaaagaacgcgaccgcgactacggctaggacgctaacgatcacattcaacgtcagctcatccacaaattgtcgtggatagcgtttctttaagactttaaagctagcgacaactgctaacatacaagccgtcacgattgtttcaccgatagcctcgaataaccagccattccaatcattcaaaccgagattaaatagatggaaaatcgactcggtcgcatagttgccaaaaaagctaaagaaaatgtaagcgagtgtggccgttagacttgtcacgataaagtactttttgcgacgcacgaacgctagtaaccccatgttcacaatgaacgtgataatgtcggaataatcgtcatacagcatgtagatcacagttagaagtacggtcatgaccgcaatagtcgcatagacccgcttctgccggagctcacgattgattaatatctgcagtagaaaaaccagcaagaccgaataccagtggtcaaacgctgcaatataccaatagacgtaaacgataactgctccctccccgcatgatgcttaatactactattgtagcgaaatccaaccggtttgtatatttgtgcgataaaaacttaacaatctttatcaaatcgctgactgacaaattaacgcccccaaccgcttcaagacccgctgtaatcatctttcttagctttagaaaaaaatatgctcgccaaaatcataactacccgtaaaacgggtagtttgctccagggctataagccctatgtactagccagcgtctcaaggcgctggcttttgtgtatcaaagccaaactgctcttgtcacttttgcgaccgctttaagcggtgttgttattacttgccttgacccttaaaagggttttcatattcccggacactcaaccgatcctgcgcttgatcatgtttttcttgatcacgaatatatttcctgatggtggcttcattaagcccaaccgtgctaacgtaatagctgactgaccaaaagtgtcggttcccaaatttatacttcaaattcgcatgctggtcgaacatcatcaaggccgatttaccttttaaataacccataaaactggcaacacttaatttgggtgggatgcttaccaacaagtggacgtggtctggcatcatatgtccttccaatatctttacgcctttatactggcatagcaagcgaatatcatcttgcaagtcacgtcgatattgattataaattatttttctcctatactttggaatgaatacgatatggtacttacacagccacttggtatgtgcaaggctgtttagtttattcgccattcctgacgtccccctttcgattttgaatgtttggctctgatcacctacattctaaatctgatgggggcgtttgggtttaaccattttgccatccgcccgcaaagcgggtggttttttgtttcgcacgctttagcgcactcaaccgggcctaaaggcataataaaaaagcgacctccgttcattaacggcgtcgctcatagattattattagtgaaagtcaccgggcataaagctctcgataaccgcggttgtattgaaggtttcaaaactatggaagctagcctcatcgatttcagcgtagcgaatagcaatctgtggacgttttgcaagatcgaacatatccacgtaattgaactcaatatacttcttatgctcactatgaatgaagccggcatagctatcaccatgctttttgattcggccagatagctgaatcacttggtcgtggtggaacgcttgcttcagcaacgtcttcaaaagtgaatgcttagtcttattatgctttttcagcaatttattcatcaaccgctcagtgttccaaatatcatagtagccccgttgtttggctagtgcgataatggtcgtcatgctctttaaataatcagtgtcactaatcacacgggctaacgatgctttacgaaaaaccaccaacccgtctagttcaccatcaacattaacggcttgaaccagcacaaacttttcatcctgctgaatcacatagccgacactaaattgctcattggttcccttggaatagatctcaacgaggttggtattcttaatcgccttagctaaatcgtcgcgaatcgcactcatgcgtgttcccccattcagtaatttgtaacaaataatttatttcatactaccatattttcaactatcatgataccacttgtaaaagtcgaacaccaaatggcaactttcattatctggataaaatttgtgctataaaataaacttgttaataacctctgctaacgcgtcatgattgttatcagcggccgtcacgtatttagcagcggccttgaccgcatcgataccattggcaacacttacaggtaaccccaccgccttcagcatcggcagatcattgctgttatcacccgcagcaataatttcatccgccgtaattcccagcaattttcctaattgaaccgctgcggtccccttgtcaacgccagccggattaaactcaacgtaacggtcagacgaataagtcacagctaacttgcttggatcaacgattgcttcaacgtccgcgcgcatctgcttgcggtcagccatcgttggtaacgccataataatcttcataacattcatcgttttgaattgttcaaagtccggcgttgtcatggtcgtaaacgtcacgccgcggttttgtaagtagtcggaatcacttggaaccggattataaatatataacgtatcctgcgtgtacacgtgtgtcgccgcctgttgattcgcaatccccgcttcaaacacgcctttagcaacctcataaggcatggcgttgactgccaatggccgattatccttattctctaaaatcaagccaccattataagaaatcgaatactgatgcggttggtcccgcaaacccatcgtctccaaatcgttctgaaacgaggtataactacgaccagagttcggcacaaaataaacgcccttagccgcggcggcctgaattgccgcggcgttcttttcagacaacgtaccatcgtcattcatcagtgtctcgtccaagtcacaaacaatcattttatacatattacggtttcctctcatctgcttgaccagccgaaacttggtcattttaggtttactattccactctagcgaaagatgtgcggaaatgcaaccgctttatttttcaatcaaccagaccatgttgaccaatatgcgggaagtctccgtgtgagattctattgccactactgcgccatctgcaaggtttaacttcatctttcgctcagacggctcggcagtacagcctgctaggcgataatttctaatggtgaccccgcaactttcccggctaactttcaaaagtcgcggtttcccctcttagtccactgctaatagtactaatcgaaagaaagctcaggagttttttgacattcaggcccaccattaatatggtgcctaaattctcaaatcataacattatgtcgtacaagcccaccgtgctaaaatcaacctaattctaagtacaagctatactcggcaagcaggccagttaaggagacgccatgaaaaccaacccggaagacttaatgcgcgacttatacaatttaattattaacccagcaacccgtgactgggaacgccatttactagtccagaccaagaataatcggcaacagctctcgccgactgggcaactaaaacaactcgaagccgatttgcgaccgttagctatgcgggataacctgacgccggatgtcatggacctttatctcgccatcactggcaacggacccacgccggctgagaacagtgtatcggcttacccaccccttagttcgccttatgaagaacgggcagtctttgctggtgggtgtttttggtgcatggtcgagccctttgatcagcgtcccggtattaatacagtgatttctggttataccggtggttcgtgggcccaaccaacctatgaacaagtgagtggtcaatataccgggcacgttgaagtcgtggaaatcagatacgatacccgtaaaatctcgtatcaagatctggtcgatgtgtattggcaactaatcgacccgaccgatcgctttggacagatcaacgatcgcggtagccagtaccggccagtcattttttacgctgatcaacatcaattgaccattgcgcaagcatccaaacaagcgcttgtggactcgcaacgttatcaaaaaccaattgtcgtggccattgaacccttacagcaattttggccagcagaaaattatcatcaggatttttaccgcaaacaaccccggcgctaccgacaacagataaaagtctttcctgtacttgctccagttcgcgtaaagacaatatcacctaatttcaatacataactattatcacgtataaaatcaatatctggtgaggttaaatgtgtttgtttaaatgtgcgtgtctcgtcatcaatatctgttattctcagatactgatgtttaccatcgtatgcttttgcagatgcatttagtccatacgtaaatccattacttagctccccaagcttacgctgctcccaagtaccagttcttaatatatgacaaatagacctgaaaacttgggagcagcgtaagttaaaatggtttttacgtgtttcaaagttgaaaaatatagatggcatttttgataaaaatagtgtgttatcagtatctggagaatttggtgttgtaaatcagattgcttttcaaggaaggtcatttgcaggaaagtctattttaaattatggaatcttggatcataatgacgttgtttatactaagagtcccttaaaatctaatccttatggaataattaaaactaatttaggcaaggctggtgtggtctctaccctatatgctgtatatgctcctttgaagacagtatactcacccatcctaggttattatttcaatctggatacgcgagttaataactacctacgtcctttagttaataagggtgctaaaaatgatatgaaagtaagagacgaagccgtacttgaaggaaaagtttgtattccagactctatagagacacagaaaaggatttgcaatctattttcgttgattgacaaccttatcgctgccaatgagtataatctgaaaaacgccctcaacattcgaggacgtttgaatctgcacttattaacgtaaatcctattgtctatattaggcttgctaaatgtttcatgaccttgtcgttatcctggttttctaattcttgaataatgtgtaaataagtttgctgtgtagtcgtcatattagaatgacctaaccgtcgagctactgaagcgatactaacacccgcatacaataataatgaagcatgtgtatgtcgcaaaccatggactgaaatcacaggaatagatgcgtgcttgcatagacgctccaaataatgattaaccgtatcattataaacttttgcttgaacaaaaattggttgatcttcgggcagctttttagtcaactgggaaaattgaatcacagtctgccaatccagcggtactttacggactgatgaattatttttggtaggtgcgaagtcacttttggcagatttataatcccaagttttactaattgaaagtgtttggtgagcaaaatcgaaatcagcaggagtaacacctaaggcttctgcaaaacgaattccagtcttagcaatcagcaagatgaagtagtcccaattgacttcgttgttcaggtttaattcatttaacaatgcctgcaactcatactgatgtagatacttcgttttatgttgacgatgcttaattcctttgataattgctttccgtgtcgggtcgcgatcgataaacccttcttccaacgcatcaataagtgaaccttttaaatgacgatgaaagtccattgtcgtttgccgttcatgggtttccgcataatcattgagcaattgctgatatgtcagccttgataaatcagtcatctttaaatctggggctaacattaccaattgccgatgtgacatttcatatttgcgataagttactggacgaaccgcatctaatttatagagttgcatccactgaaaaaaatactgatggaacttaacatgctgtgccataataaacctccaaaaaatgagttaacagccacttgcgcggccgctaactcatttatacatgaataattattcatttggctaaaattgacacttacaaataaattaatactatcgctgtttagcagggatagcccgtaaaaaatccatgaatttaaacaaacatattttgcattaaatatttcttcaactttttgagttgatttagtttatcttcattggcagcgataaggtaatctaatcgagtaatcagctctcctatttttttttgctcagtagcttctagtggaaacttcacccgcattgcggataatgcagttcctgaggttaatgccctagtagtcattgaactttttgtaaccatttcttttcggaaagcatttgtaaaaaaaacatattttttaaaaatatttactagttgacctggtttttcaagagaacgtccacgtaatacaaaaccgctaaaaactgtatcttgtggttcactcaacattacagacggaaagcctatttcttcaatagtctcagatgtccttgtaaagaaaatatcacctttatgcactctgaaattatttatctctttttccgtaagattgactcttccatttaaattttgagcgtacaatccccgattatgaaatacatccacgaagtttactataggagtaccgaatccaaaaaattcttttcctttatttaaaccattcttgaaatagtacatttcacccagcttacgctgctcccatgggtcagtgaatcccttgaagcgccatttctgagaaaagatcttttgcatcatcaactttttgagagtttttaactgttctagtttatcctcattggcagcgataaggtcatccaagatcttaattgtctgaactatcttaatctgttctggactctgtgggcaaagaaacgagtatgcatctaactcacttctgttaattttcggcataccagtcctcatagaaactgataccgaatatttgtagaaatttcttgtttgtaaaagatagaaaatgaatccttggtttaatatattcgcgcttttcgtagtcaaaacatacgtgtctgcactagatagtccttcaaagtctgcccaaatatatttagctaactgtggattgatttttccatatataatattacctttataaaaatgaaattttccggaaataagatgatctttctcaactgtgttgacattatcaaggagttggcctgaaaatgcctcaatatttcctggtccaacatgtggtaattctgaaaattcgacatcacgtggatctaccatatcggttgaaatatcgattagatcagcccacttacgctgctcccaagggtcactaaaccccttaaaccgcacttttggcactaaattttcgtttttcattgtaacatcctcttaatggcctcaagctgctgttgagcgacagggtcagtcgccactaaatcggccatcattccggataattcagattgtaggtcgttgattttggcatccgcttcgcccatttccttaaccaacttatccacatcaacaggtggttcctcttcgaatgtatcgacgtatcgcggaatgtttaagttatactcgttttcgacaatctcagctacttctgcacgatgagcatacttatccacatcttcacgtttttcaagggtttccaaaatcttatcgacattttcgtccgttaagttgttttggttcttacccttttcaaaatcattagacgcgtcaataaagaagatatcctgacgttcgcgccccttcttgaagaccaatacaacggtcggaatactagttccgtagaataagttcgctggtaatccgatgacggcatctaagacgttgtcatgttcaatcatgtactgtcggatttttccttccgcagcaccgcgaaataagacaccatgtggtaatacaactgccatcgtgccttcattatttaagtgatagagcatgtgttcaacaaacgcaaaatccgccttcgacttcggtgccgtcttcccatatttccgaaaacgttcatcatctaatttatcatctggattccacttagccgaataaggtgggttggcaacgacagcgtcaaaagttagatcatcaaagtgatcttcctctaaagtatcgccttgacgtaaatcaaaccgattataactaacctcatgcatcaacaagttcatccgcgccaagttgtaagtcgtaccgttgatttcttgaccatagtagtttccaatcgttgcgtaattacccaattgtaataacagcgacccagagcccatcgtaggatcataaaccgtcttcaaacgatctttaccagccgtaacaattcttgccaataacttagaaacttgttgtggcgtataaaattcgcccgcctttttcccagctgaagcggcaaattgaccaatcaaatattcgtaggcatcacccaaaatatcaattttaatatcttgttcaccaaaatcaatattcgacaaggatagaatcactttggcaatcagttcactacgcttggcaactgtgtttcctaaccgtgatgactgcaaatccaagtcttcgaatagccctttaaagtcattttctgactctttgcctaaggtcgaattctggacttcgttgatggcattttgtaacatttcaacgtcaaaatcgccagcgttaatcttcttgaccatagttgtaaacagatatcgtggttcaatgaagaaacctaagacgtcaatcacttcatccttcaaatcttgcatcaggtcagcatcttgttccgcatctgcaaagtcaacatcatcgtcttgaagtaactcatttgcatagttttcaactttttcggacaaaaagcgataaaagattaatcctaagatataatttcgatactcactggcatccatgttaccgcgcagatcatttgccacagcccataatcttttttgtaattcagcctgttgttcggcctgttcaatatgactcattaaattcattctcctagcttagtgaatactttcggtcgatagtcgatacaaaatccttaatctcgcgtttggcctgccgtttctctcgaaagccgagcccattagcacttaacttgtcaataatctctttgtccttggtcttaccgtagaagttgtagtcagaaatctgctcgttaacgaagtcttccgaaaggtggtgttcttgtgaaaagcccttaatggcagctcgctggctctcggccataaagttactcaacgacatgccgatatcatcgtctgtatcgagcgttggcaaaacttcattcaaaaattgttccaacaattcaaccttcgactttaattggtcattggtcgcattatccaacaaatgttcaattttctgaatatcttgcttacgttcggtcgacgacattaagtcaatgcctgagattaagttcacaatatagtcaacattgatggtatcagtctccaatagactgatatcaaagtcaacgtcatctaatattgagacgcgctcctgcgttttgcgttgataaatcgtttgatacgccgtaaaatatttgccccgaaaggcttccatcagctgatccgaaaattcaggttcatattgcgcccattcaaaatcatcatacacgcgaatacgattatatacccggaggaccgcccgaaacgccatcacaaactcatatagtgcgtcatcgcctcggttatagaggtcgtccactgactggacatctggagtcaccgtcagtaattggccaatcttgtcagtaaattcagcttttaattcatcataatctggtgctaagaagccggaactgtccccgtctgaaaacaacgctacagcctcatccgtcttatttttgatattgcgataagcaataatatttccgaatggtttttgtttgccctcaacacgattggttcgagaaaatgcttggattaaaccgtgccattgcaaatttttatccacgtatagtgtggacaaccgtttggagtcaaaaccagttaggaacatgttcacaacaatcaaaatatcaatattatccgtcggcgtttggtcattatgatcgcgcatccgcttagaaacatccgcaaaataatctttgaatttatccgttgaaaaatccgtaacgtacatttgattatagtccttcacgacttgatctaatcccatccgtgaagtgatatcatcctgtttttggtgttcctcgttgtcgtcctcattggcagcccatgtaaagattgtcgtgaccttcaaattatgatcagggtccaaccttctaaacaactgatagtactttagagccatgcgtgtattcgctaccgtaaagattgcattgtaatgcttattctttgtaatatggctatgattcaacaagatatgctcgacaatcttggtcaatcgctcctcggactcatagacctcttgcgtatcaattcctggtacttgttcgtctgtaatgtcatggtcagtctcttcaaaggtcgacagatactgaatcgaaaaaccaagcacgttaccatcacgaactgcatcacgaatcaagtattgatgcaactgattctcatacagatcttttgtggtccgcccatcgggtcccatgttctgttgaaaaatcggggttcctgtgaacccgaagtgttgggcattcttaaaccaatggttcacgttttttcgcatttcacccatctggctacgatggctttcatcttcaatgaagattactttgcggtcatggtacggtgtcagaatatctttataccgatcattagagaccgcattattcatcttctgaatggtcgtcacgattaagccattatcattagaggacagctgcttgactaatgcagcagtattgtcagtccgatccaagggactctggcccccagttgtttcaggcagataggcactaaaattttttaccgtctgaatatccaagtcagcacggtcaatcatgaagataaccttttcagcatccgtttcttgtaataacaactgactggccttgaaggaggtaatcgtcttaccagaacccgtcgtgtgccacacatacccattttcatgggggtggtcgatagcttgcttaataattgcctcagtggcatatatttgataagggcgcattaataacattttatggtcactactatcgaacaccgtatattttgcgattaaactatgtaaccgtggtttactcaagaaagtggtcgtaaaagcgtccaagtcattcaaccagttattatgttcatccgtccagtagaacatgaagtttgaatttaactcaccatcgccattcgcaaaataccgcgtttcattgccattggaaatgacaaatacctgaaccagtcgcatgagttttgcttgtgcgtacgattcagttcggtagcgaataatttgattaaaagcctgagtaaattcaaccccttgccgcttcaactcaatttgggcaattggcatcccgttgatcaagatcagcacatcatagcggttctcatgacgaccttcaaccgtcatttgatggctaacttcaaaaatattctgatcaaattgttttccattaaaaatttctaggtataagctgctatcatcatcacgtttaacattaattttcccagttggctgaacaactgagccacgtaaaatttgggcaacttgataatgcgtcttagcgccaatcaaatcatttaatacggcctgaaattcacggtcactcagtggtgttccctttaaacgttcttgattacgttcactcaagaccgcacgaaaatgtgtgtttagcgtttcaacatcgggaatttcaacgtaatgatagccaatgctttgtaactttcgaatgaggtgattttctaattccgcctcagattgatgtccacttgccatcataggtcctcccatctatacgactattaattagccgtaatactaatcaagtctactctccataattaccaatatcatatcatatttaactgacgctgtaggccagtgttagttatttctatcaattattaaatcattggcaataaactaaacatggtttgattgcaaactaaaaaggtagcccgcgctgaaacgtccagcatcgaactacctttataacgaatattaacttattttacaacttccgcgaccgccgcattcacagcgtcacgttcatcttcaactaaggcaacgcgactggcgattaccttcgtatccatcttaatttcacgcgttaaaccaggcgtgttgatctttggttcaaagaacgccttgaattctgctaaacgttcagccgtatggaagacccgtgaaatgacggtgatataagtggtaaattccatgtcaccaccaaccgtggcttccaaccatgaccattcgtcgcgaatccagtcccaagctgcttgttcaccagctggattagccaagacaccgcggaaccaggcccgcaagtcttgtggcttaatcgtatccgcatcttcaaacttcacaactaactgtttgattaattcggggtccgtagttgcggtcagtgcgtcacaaatgtcagccttgtaactagcatcggctgtctgccgtgacgccgtcaataaactatcgaataagtccttactgccaaagttcttgacttcattccgtaaaatgaagacccgcacatcggctggtaaggtcgctaacttatcacggttaccttcgaataattcatgggcagccaatacagccgcgctattcttggcgtacaaagccgcactcaagacgtatggccgcgtcaactgatcatcgttggattcaccagcttgtggcaaccaccctaaccgtttaacctgagcggcactcaattggtcaaataacgtttgtaaatgcttttcttcatcagaatctggcgtaacaaacttacgtaagttacccgcaacttggtacaacgctgcgttaacgaccgttgaatggctagctgcaaaccggcttaataatggcacaacggctgcgtatgagatttgacgaccttcagctaacaagcgtaagtcttgtaacaactgtaactggtcaatggccgttaagtcatcaacatgcgctagaatatcatccaataacgtttggtcatacttgacgatgaagtgggagttattcccaacgttcaagcggaatggttgcccactcgcatcacgtaatttggcataatcgccgatcgtcacagcttggtccttcataatcgctggtgccgcctcatagttgctattcaacggaatctgccattgacgtccgacttcttcaccttcaccgatgaagaactgttgttgtgacaaggtcaactgaccgtcaacaaccgctgccgtgaccactggatagccaggttgttccagccatgaatgcatgatgtctccaacttgcatcccagaagcatctgctaaggcgttccacaagtcatcacccttggcattaccatatttatgattgataaagtactgcttcaaacctgctcgtaaggcatcatcaccaactaaggcccgcgccattactaacatccgcgcacccttagcgtagacaatcgcaccgtcaaaaatcgagtcgatttcggccggatcttccacctgaacgtggactgactgaaccccatccgtggcatcccgttgaagcgccattgatgcttcggacgtttggaaagtttcccaaatatgccagtctggttctaaggcatccgtcgccacatattccatcatgttggcgaaactttcattcaaccataggtcatcccaccacttcatcgtaaccaaatcaccgaaccattgatgggcaagttcatgggcaatcaccgtggcgacccgttgtttcgtttcgagggccgtgttgtcaggatctaacagtaagtatgcttcccgataagtaactaagccccagttttccatcgcgcccgccgagaagtctggtaaggccagttgccatgagtgtggcaatggatatggcgtctgataaaaatcttcataaaattcgattgagcgcttggcaatgtccaaagcaaagtcgagctcgttagccttgtgagccttggtgccgaaaacgccaatagtcacaccactcttggtctttgtctgcttgccttgtaattcaccaaaggcaaacgcaatcaagtaagtcgacatccgcaccgtggtttcaaagtaatgcacgccatcggcttcatgatcttcaggcatgttgcttaagatcgtttcaccatcatgttcatcgtacttgatggcaagatcaaaagtcgctttagcttctggttcatcgacacacggaaaggcttgccgagccgcggtcgtttcaaactgcgtcccgattagttctttcttcacaccgttgacttcgtaatatgatgggtagatacccatcatcgtgtccgtcaatttggcgctgtacgtaatcgtcaaagttgtttgaccggccttggcaagttcaattcgaattccttgaatcgcatcatccacagtgaagggcacgtccgcaccatcggcttggacaccagcaatggtcaaaccattctgatgaatcagcacttcctgcgccttagcatccccggtaatcgttgacttccccgaaatcagcttatccgcccggttaatattgatataaagatcgtaatgttctggttgaaatgtttcgtaaaaatgagttgtggttgccatattattctcctcgttttttaagaatatattcattatacgacaattgcgggtggaatgcgtcctctgccgcccatgaatttgtcacgcgcctagcaactaattctcgacaacccccatcactaatgatgacacggttccttgcaccgtacgatatcgataatcattagtgtaaacgacgatattacgccgcttgtctaaagtcatcaataatttcttcaaactccgcatccgccaacaccggctgccacttcagcgactgacccaccggctccaacatgatgtagcgacagctatagcggcgttcgaattggaccgtggtcggcaataattcaacatggcgcgtgtcgtcttgaatccaggctgtgggcaaccaactggtcacgcgactagcatcgacacttaactcttgcaactgctcggcaaaccttgtccgcatcagtaacggcgcgtccattggcgagccggccacgtcaatggcaacttgaaaatgaccgacgtatagcgctcccaaatcataaatcaaacgttcatgcttatgtagcgcaattgcaccggtgactggttgccacgtggctgtcgctaaggcagcctgattgatcctggtggccacaaagtagcgtcgtggctgaatggtacgggtagttagtggtactgatatatttgcctttgtcagtaatttcggattggcagtaaaacattggtcagtaagcttatgaaacttgtgatcatcttcattgctaaaagtaactgtcatttattaaccccatctctatccgtctaagttgctactgagtaccatcttccaagctctaatcatgaatcatcaccgccacctttcaatggtcagccctacgcacacgttaagccgcttctggctcccagcgttcaaaagcgccaatcagattctcagtcatctgtagttcgcccatcacactaactagtgccgactgggcgttcataaagagtgttgaatgcacaaaccgttgagccttggcattctcaatcagtcggcgtacctgcaaccgctgggccgtcagcaattcagtttcggcctgacgtaatttttcacgcgctgcctcgtagcgataggccgcaatctcggctaaggcagccgcaatcaatgaacgggcgctgccgattttcaaaatcatcgtcatcgtaacgttgagcgtgtgttccgtattcttctgcatgtctacaccttttttctttgaatttcctactctttgaccaatcatacacacctatgttgacggtaatcttcatcatcacgccattccccaaaatgacagcaatcatgatcgacaatcagctttaaaatgtcgtgccgttcacatgaatgcgccggccgttagatgtcttgacaccgttaacttatgtcatagtatagcattattttcagaaaacaattccgactttctcaatatatacataaactttacaaaatgaaaaccggggcaatttacgtgcatttgtcccggcttttatattaatattatattttcacagtgattaatttatccctgcccgcactaccgatcatgacacccttaattaatctaatgagtcagcggctggactggtctttgattcatccccatattgccagtcgcgcatttgatttgccgcggctgctgaaggataggcgttattatcgaaccaggcccccgcaccactagcattcattaggactggaatttgacggccatcaaaataatgataacgcacgtattcaaagttaccggcgccagcagtctgctcggcccccataatatgaatccatttttgcccctcagatgccacataggatagcttcaacccatcggtatcattttgcgtcatcgaattaattttatggtcatacgtatcatagtaataccaagtcccctgataaccttgaggccattggttagccttcgcatcacgactcatgttcacgttgagggcactgtccgtcagcgtcgtcggccgactgcccgtaatgatcttggcaaagccggcttgcaaagcactgttctgcgtatcatgaataatcaggtcgttaccattagtcgtctgggtcacaaagacgactggccgacgattatgcaagcagaaaaagtacgtgattggatattgcgcatccgccttaccgcccgttgcgaccgctactacttgaaaggcactactatcttcgccatccttggaccacttgagatccacagactgtgagccccatttgattcgactggctaaactactatcagaaaaagtctcgggaaagcgaaagcctaagtgatcagggactttatcatcatacgtcccaacataggtctgtcccatatcgcgttgccaagccgccataaatgttgacaaggccgctttcttacccgtattccacaaggttgctttagccggcgatgatgattcactgctggtagtagcactttgattagtagtctgcttggatgtcaccttggttgacgtcgcctgttgcttcgtcttaggcgctgacgacttggacgacatcgaacagcctgctaacaataaacttcctaataatagtccgacccacacctttttcataatactcacaaccggtccgacaccggtatccccctatttaattactattcccatggtaccaaaaaagtcggtaatgtgctgggcgttataatataaaccttcacccgccacacttaccgactatggctatttacttaatcgtgatatttagtgttcctaaatgcgtgatttgaccgcgcagttgatcgccggcttgcaaaaagacttgcggattgcggccaacgccggttccactaggcgtcccagtaaaaatcaaatcacctggttgtaactcacagaccgtcgacaggtagtgcactaaatccggtaccttgaagatcagttggctcaacggcgcttgctgcatcgtctggccattgacagtggtcgtgatcacctcatcgtctacgttagctaactcatcgacggtcgttaaccacggcccgactggtgcgtaattttcaaacgatttccccattgaaaactggggattgtcattctcgaactgaacggctcgatcagataagtcttcaccaaccatcactccggccacgttcgccattgcatcagccgtcgcgatatcgcgcccacccttgccaatcatcacgactagctcggtttcccagtcggtctcaggaccatgcgtcgccacggtcacgttcgctggtgccagtgaactactaaacttcgtaaaaatacttggaaccttcggcagcgtaatgtggatctccgccgaatggtcacggtagttcatccccaccgcaaaaatctgtcgtggggccgtgattggtgccgctaattcttgcggcgcaaacgtttcaagcgaaccaagttgccggtccgctgcaggtgtatgtagtgcttccaaaactgtcttcgcatttaaaactgtttgtccatgctgttcatccgtaatgataaacggtcggttggcccgcatgccaattttcatattaatcacctcattaatattattgtacactcatctcatgaatcataacaataatgatagttgcgtgacggtcattccggacaatctttatgaacgttcaaacgcaattacgaacttagctcaggatatttcttcatgtaacgctcatcactaaaaaaggtacccgcctaatttgcgagtacctttaaccattacggctgccattaatgtgggccgtcatcctttggttctggatgtttcttttctggtgctttttcttgcttgtcattttgttgccgccactcttctgtcgttaacatgtctttaacgactaattttaacttagtcacttgataaccagtcattgatttaacggccttggcaaccttatccgccacccgtgctagaatctcctgaccattcttaccataagctagaatggccgtcaattcgattccaaccgtctggtcatcgtcatcggtatccactgaaacgccggtctgcgggcgatccttatccgtaaagcgattggaaatatcatcaatcagatttccctgtaagctcaataccccttcgacttcttgggccgtgttactagcaatctttgccaataccgtatcgtcaaaaacaacttctggttttaaagatgtcgctgttgcttccatcaaaattcctccttgttttgtcaaaaatcgtcttaccaatgactactctaaacgaccatgctattcaacttgccgtttatctgttgattgatccgtatttggtttgccagtggcctgatcttgccaatcacgcttgctcatgacgtcactgacatgtaccttaatttcaatgaccttcaagccagtataccgttcaacatcttgctgaacacgttgacaaatttgattgaagatttgtcgcatgtccttaccatattcaacgatcatcgtcatatctaaagcaacttgtttcttaccaacttgggcgtcaaccccctgcgtcgggtcagcttcatcacgaaagcggttcgttaaattgcttaacatgccgccttctagggataacacgccgtcaacattgcgtgaagctagaccggcgattttttcaatcacaccgtcatcaaacgtcaattgagtctgtaattgttgttctggttgtgccattgtaattcctcccattatttagataaatactcactcaacttctgactaactgcagccaaatcgacgtggacaaaccgtccaatcgcccagccgatcagccctaaaactgcgactaataagactgccgaaaaactggttaatacccagacgatacctaaaagcagtccaatcagaaaaccatactgtgcgttactcatcaggaccctcctttacaccacggttaacttacgctggtgatttgctggcttaacttgcactaccggttgttcgaccgtcaatcccaattgattcttcaaatagtcctgtgccaaggttgccgcctgttgggccgtggtttctaacgatgcgtcagtattaaccatcgcatcaatctttactcgtacccggcgacgacgccgtaatttcaagtgaacctcaggatcaattagattcaactgattaacgagtcggtactgcaaatcacgttccaaagcccgttgcggaatcgttaactggccaaccttgccatcatacgtcaacgtgctgactttaactggtcgaaacaagccgacaattaccaataagataccaacgattccggcaataatggcaaagaccatcaataagatactccaaaccattgggtagttaatcgtcagatcagctaaccaggacgtcaaccacgggatcgggtacaactgacccagttcaaaaaccgctaataacaccaatacaattccgactaacgtcaccgtaaacttagctaagcggctcatctaatcaccgcctaacgtttcttacgcatgccgaagattgcagaaacgattaatactaagataatagcacctaagattgagggtaccaatgccataccagctaacgaaggtccccaagttccaagcaatgcttgaccaatccaggcaccaactaaaccggcaataatattgccaatgatccccattggaacgtcacggctggtaatcgcacctgctaacgcaccaataacaccaccaacgattaatgaccatagccatcctaacatagtgatcactccttaaagttttatttgagtacatgcttataataaccataattttatttccggacaattaatatgcatatttaccaaaacagttcttaaaatatcgctggttagtcgcgacgatccttgatactacgcaatttaattgcagatataaaaaaaccagcttgccaattacgcgtcgcaagctgattatttattgattgaattaactcggatactttctctagttttcctaaactaggctggttttcccggcgttttctgagcggtttgcaatgcttgattgatcaccttggcatataaaatatcgccagcgcgaataccaccgaagtgtacgccatccgtgcctttgaagacttccggatgttgcgcggcaatcttgccccaatcggcaaccgtaatgaacttatatttagcaggcaaacgccgctccaaaacagccaacttcgatgaattccagtcagcatcggcccgggcattataaggtgtcatcagaatcaacttgtgccccggctccaagtcatgaatgatcttcatggtttgttcttcgtaatcatccagcgcgttggtcccaatacaaatcaccacgtactgccgtaacgtatggcttcgctgctggttcatcatgactttatacgccaggttcatcgtccgatcgccttccgcatcaatgctgctatttgggacgtggtcacccaggtagctccgcgtccccagcgtgacactgtcaccaataatggaaacgcccggggtcttttcttggtcagctttaggcgttgcccgcttcttcttgggcgtcacggccgcgagcacggcttcatgagtcgttccgattttatcaatatcttggtaaatcccactcacccataaattctgttccagcgtcgaaagttgcggcgcatttttgaccacgaccccggtattgactgccaacagcactcctgcagtgataacgggaaactgcaactgtcgccacgtcaacgtatgaccgaaaacgtgcgcgcgtttgcccgcaatcactggttctaacacgtagtatgacaacgcggataggataatggacagtatcgtcgtgagcagcgccgccaaccagttgaccatcatgtgtgaaaaaatcacgtacaacggccagtgatagagatacacgctgtagctcacgtccgctaaaaacgtcatccaccgcggttccttgaggttcggcgtgtggtcatgtaacagccgggcgccatagatcatgataccagcgagtacggtggccagtaacagtccaccctgatacgtttgtagcgcatcgaacttcatccggtcgcctaaagcaactaacaagataaaactaatcaacatcaccgcgctcgcaataatcggattgcagtgcgccgtggtccaacgatagattggcccttgagctttgatgccgctcaggacaccgataagcccgccgacaaagaacggaaaacagtgggtcagacttgaaaagtagactggtgaaaagtcctttaagccgaccgcgccaaagtacatcatgacaaagctttcaatcgcaaaagcggtggtcaacagccctaagccccagcgaaaacgggtcaatgcgcgccgaccactcgccaaccgccgactaattttagcgaccaaccacgcaatcaggccccataaaatataaaagtgcatttcaaccgctaatgaccacgtatggacaaataagtgcggaataaacttgttttcataactgccacccgtcgcaatttcaaaataattagtcgtaaatccgagagccgccgcgacctgcttaccaatgtcggtcacaaaatcgtggtcaatcaagtaagttagcggtagcaccaataacaccgcaataaataatggtggcacaattcgataaaaccggcgaccatagaaagccattagtttaaagttatccgaacgagcaaactcgtccaccattaatgacgtaatcaaaaaccctgagaaggtaaagaagatgtccaccccgataaagccaccagtaaactggttttggaaaaagtgatacgtcaataccagcacgagtcccgttatccgtactaaactaaaccatttaatccgcattttctaacttaccgtcccccgtaatttttttggcataagtcttgttgccgacccgcagtttgaccacaccattcaacgcacccttgctgaagttgccttgcaagcgccacccgttcggtgcaatgaattcgcctgcaccttcaaaccggccattggtaaaattacccacgtagcgcccctgtttgttaacctgcaacgtaccctgaccgtcaaacttgtgcttcaaaacggccccgttgtagctcatccgtccgtgatccaattgcacactttgctgcttcgccgttgatggtgttagactgataacggcaaaagtgacaataccgataatcgtgataatttcaaagaccattctgctactgatttttcccatacctctattcctttcacaaccttaattccccttgtaatcaacaccacagactctcccattcgtctacgggtttacacagaccatctcaatcattgcccaaaaacaatgatttacaagtaatagcacatacaaatttgtttaattaaataattaaaacagttctaatagttatactaattaatatattactaaatattcagtctatcgggtagatgaaaattaccacttattgatttttcatcatcatctacgtcaactttgataaactcaactaaaaatcaatcataactactctgagacacgaaaaagcagtcaactcatcgcatttgactgcttttttaaataattactttcatcgttacagcaaatcagttccagtcacccaatttgccctgagcaacatatcaacaaagaattgacaatatctcaaagtaaccgactccgtctgagcagtactatgcacccttgctgatgggcagcgcgctacacgtatcatagtttgagaatttcatcgtcttttcttcaatatacactacatttaagcatgtgctaccgactgaccatccaattagtgaccgccttttgctattatgcttactcttttttcattagctgctgaccattttgtattgataatacttttttatctttagaaagtttagcagtcgctccattagcggttttgccctcaaaggttacctcattatcttccacattaaatgtgccgctatatttgtccctgtaagtttttttatgtcccaacacgtcaaccgtttttacgactgtttctttatagtttttgccatcaaaaacgatcgtatcggttcccaattcttcacttgtacttgtatacgttccctgcaaaccgcgtggcttcagtgcaattatggcaatcacaatcactacaataccaataataacgccgatgatacttttcttagaaactgtcatctacttcctccgttgctgtatatacttatttacctgcatgacgatcattcaagctttcattttttattaattcctggcaattcgagcaaaaccctctttaagtttcacattctcagtctctcccagagtaggcgtcccatcccggctttgatcaacgagcacgattgggctgccatttctaaacgcaaagaaataggtaatatggttaggcagtggcggctcggtcccatcgtggttgtaaatcgcgacaacgttgtattcatgtgtgcccttaccactgggtgcccaggcaatcgaagcccgttgtcccttgacgatgacatccgacaaatcacgcggatacaataatccggtcgaaatgtctaactcatgcacgccatcatacttggcataatcctggttcattgtctgtgaccattgcgtcataaatgcgtctaactgcttgtctttgctagtattccacagcacaccgtctttctgattagctgctgttgttgaactagtgcttgtcatattttgtgcaaagacctgcgtataattattattactagtccaaacggtaattaaattctgacggttagtgctgccagtaccgtcaacttgataatcactagtcgtaccggctggatagaacgtcattgcccaattactaccatcatcgttttcagttgagacactgaatattttgccattattacgaagctgggtaacctcatttttaccatcaaccgcaatactatttttcgtgacggtcaacgtgccagtcgtaatcttatctttagctatcgataattgcccgttgacctgactagtatcaaattccataccattacctttatgatagttcactttggcaccaatcatcttccagtcactacccgtcaaactacgataattgccggttttaatttcagccaggttcatacacgttccggttgctgttgtcttgtttgtttgcgaagatgccgtgagacttttgcgtgctgatggagtccgtttacgcgttgtcacactcgttgacgaactcgatgcactagccggactttgcgcatttttcccgccgcatgccgacagggtcaccaacatcacgatactcgtggtactcagcacgaattttttcaagccattcatcattatttccgtgaattcaacgccgaaatcgttgaagaaaccgcggcaattccggaattgaccgccgttgcgtgcgcattagctgcgatatctgcttgaagactcttgatttcttcctgtgctgccagctgatcttcttggaaatgctgcgtttctaaaagattgaaggcttcttgtaaatcccgcgctcgattttcattcactaacttccaaagccgtaacgcatcccagtaattgtagaatttctctgggaacccattggcctcttgttgataaactggattagccagctcttgttgtaagcttgcttgatctttttgaatcgcctcattagttggtgacagatagtgcagatacttgaatacaaacaacccgatggcaatggccgcactagtaatgaccaggctggcgccactttgcaacagtaacgccgccacagccaagataccgaatccaataatcgttttatggaaccgtttcttatccttagctaatttatcctgatcagcggccagcgcctgttgcgcactagctacccccgccgtaacacttcgcttatttttcaaaaagtccaaaagttcttccctcgtcatttgctactttcccgctttctattccaattttttattaaattcgcttacgacgcttagttacacccagtaacccaactaatccaatcaccatgagtcctagtactgaaacagtacgatcagccgtttcattcgtttgcggtaacgtgctaattgatttagtggtagccgcagccattgcggctttccgttgttgcaaggttgtggcctgctcagcactcaacgcgcgatgtgccttcaaggtcaccgtgtcaccacccgttgtagcgtgttcagtacctactgcgtacttcgtattcaatgtagtaccgccaccattagtcatatcatgttcagtatttgtcatactttccccttgggccgacttagactggctcgtctcctggtttgtacgatcaatggcgtcattaagtgctttagtctgcaataactggtctagtttagcttgcgccgcgaccaatacttgcttagccacatcggcaacttgttgtaattgttggtacgtcactgcatcactgtccgcagttgtttgagcaaccttaagcgcttgaaccgcctggtcataggccgcttgcgcatcaacagcggcttgcttagcggctgccagattagcatccgcatgcgtcagtgaattcaaatacactttcttattagctaacgcttgttgcccagcctttagcgcagcctccgcattcgccaacttggccttagcttgggcaagtgcttgattagcggttgcaagtttaaccttagccgcagttaagctcacctgcttttgggactgaaccgcttgcgcagcttttagcgccgctttggcatcactcaatgcttgctgcttagtagcatcactcgcactagtttcatcaacagctttttgagcagcggcaaccgcagccgttgccgttttaacagcagcttgagcgttggttaaggtagttcgggcattggcttgttgctgcttagcggttgctaaagtagttatagctgcagttaacgcattttgggccttgatcgtattggtatttgccgttgctaaagcagtcttggcggtattcgtagccgtcttcttagtggcaaggtcgctttctaattgcttgatttcattagcgctgactgtttcatttttaatagccgtcttatcaaatttactttcgtcgacccagtacgaagaatcctgaggaacaaacgcgaagtgagaatcaaaattaagtgttttccccggagcacctaggacattctcaccaatactgtcgctaaaggacacaccaaaatactggtctttaccatgagctgcagcgcccaaaatgctattagcatggctccattcttcgtcattagccataaatgattgtaacgaagtaaaaatcatttgcttaaaatcatctaaggttaaatgccattcaccgagattagatgtcgcttttgcaagggcagcatcttcatacatgttagcggttgcctttgaaaacagtccattcttagcggcagctcgattaattgctggaacgtcatgggcattttcaaccgctaatatccactgatcagcagtgacttcatcagcaatatcaccagcaaacttgacactaccatttgtaacaatgacatgtggcgccccaaattcatcccgcatcgaattaattagttgggcggcgtacgttgataattggcttaatacttcgggagtcaaatcttggcgaccattgattttgatattcttatcgaccgcgttcgactgaaatttaagcatctgactcattgcgtcagatgccttgattaggcgctgaacaacgggatcactactatttagattgtagccttccgcgtcattgtatgctttcaaagcattaacatactcagtacctaaagtaaaagtttgggtgctcccctgatgttggctagcgtcatccaacgccttttgcgccgcagcttgtgcttgtgtcgccgtattaatattttgttgggcagcactttgggcttgattagcctgatcaacactcgtttgcacactcgttactttggtctgtgcatcactaactgcttgactggcctgcttcgttgcatcattagcctgcttaacattggtttgcgcttgacttagatcttgttgcgccgtcgccaagttttgttggaccgtcgcgctatctttgccgtccacaacgtcttgggcatggtcaacttgtgcttgcgcgttagcaaccgtttgattagcttgcgtcgcatcagtattcgtttggtcgactacagtttgggcgctattcacactatcaccagccttgtcaacgtccgttttagccgtatcaaccgtttgcgttaattgctggttttgattttgttggttagtcaccgcgtcttgtgcttggttaatcgcatcatcagtcgcactatctgcaacttgttgtgcctcggcttcggcggtcttggccgtacttaaatcaatttgcgctttagtcgttgttgcttgcgcagtcgacgcttggctttctgactgtgccgcggtccctttagctgcatcaactgccgtttgcgcctgccccgtcttatccttagcgtcatttacagcagcttgcgcattcttaatgtttgcatcaagttctgattgactcgtcttggccgtttgcgtctgccccgttatcgtattattagtcgttggattggtcgtatcggcttgtgcagtcgttgcagttccaatcgccgttgcgcctgcagcaactaaagccgttgacatcaaagcaattcgcgattttttcataataatttcctccaatagtcttacatcaacaaaacacactataaaaaagagtattaagaatccttttctagcatttataatatcataaagaacgccattttagtatatctaatactactattgtattttaaatacgactgttttctataaaatgaagttattatgacaatggaatattttggtgacaaattaaaatcattaagaaaagcaaagaagctaactcaagttgagctagcgcaacagctcgacatttccaaatgggctattacttcttatgaacaaggaaagacgtaccctagtattgaagttttaatcaaaatttgttcggttctcgacacatcatctgattatttacttggaatttctgacaaattaccggttaagatgagtacactcggttttacagatgaggaggtccgattgttactacagttcttaaatctatttcagcaaaacagaacacccattgataaataatcatatcgattgttaatgctttcactcatttatccataaaaataacctgagttccaaatatcattggtttgatatttggaactcaggttattttatctgtttactgttgaataagaattcaacgctataaattacgcatgcttgcgtggcttaactaaaccaaatagtgccaaactggcggcaaataatcccactgccatcaaactcgatgactgtttttcatccgtttgtggtagagccgtggcctgtgcggcaactggctgttgtttagctcccgcaaccagcttggttgtcacatcgccatctgaaacatctacgctagtactcgtggcattaatggtaccattactattcgctacggttttagtagctgtcgcatgtggtgcggtaacaccagtcgattggtcaacatttgttgtttcagcaattccatcagccgcagcagccgtcgtcgttgtaaatttgtttgcttcgacgcgtgccaagaaggctttagtagccgttaaatcaccttgtgcaacggcgagatcaactctggcagcgccgagcacctgcttaagttgtgctaaatcggtctttttacgatccagttgcgcttttccagcagcaagctgatcgtttgctgtatcgacttgagcctgcccctttgcgagtacggccttggcagcagcgagttgttgttcagccgtagcaatttgggccttcatgcttgcaatccgcgctggcaaggccgcaatttcagccgtcagtcgggcgttttcagcggtcaagtcggctaccaatgtcttggcactggctaagtctttagcggcttgcgtggcagttgcttgcgctgcggccgtcttcgcgattgctgtcttcaaattgcgatcaggcgatacttgttgctgttgcgccattgctaattgcccttgagcttgcgtcaaagcaacattagccgctttcaaactagttgcagcgacttgaacttgggcctgtttagtcgtaacagtcgcttttaaaccacttgtctggttttgtaaagcttgtaaactggcattttggttagccagcgtggttgctaatgtcttcccggtattttgtaaaccattcaaactagccgttgccgcaatcaacgttgcgttagctgccgcaatcttcttcggatcagcgggggccgtctggacgtaattgaacgtgacggctggtaaggccttagtcccagtagcggcattcgtatgggcattgtaaaacaagtcatcatacttgacttgctgggcttccgtcatcccggcattatcgacttcaaacgctgccacgtgtttggccaagttgatggctactccggcatcaccagtcgagtatattaggttgacacggtgaccaaaggaaccggactcaacgttattggattcatcataccaacccatcacagcattataggccgtttcttgatcgctcatgaaccattgcggataaacttgtgttaaattttctgcatagcttgagccagtatgatccaagccaccgtcgacttgggcagctgctcgcgcaatcgcattattttgcaacgtcgccgtctgtttcaatgctggttgaccattcagcgcccgtagctgattgatatattcaaacatatactgattgattttatccgcattaggcatatacttgccattacttggataggcgacgctgactgtttcggccccagtcaattgagattgtgggaattcgtcagcgtcatacttattttgcgattccgtcgtggtcgttggccgttctgctgccgctaaagctgcttgagctgcggtcactttggcttgcgctgtggaaacagcttgattattcgcattaatttgaccggtcgtattttgaatcgctgtcttggcagaattgattgcctgggtattttattaaccgcatcttgcgctgatgctacggccactttagcttgatttgcttgggtggccgctttttgctgggcggcagatgcttggtcgaccgtcgcctgtttagcggcagtgacggcactggctgcatcggcatcagattgggccgtgacctgttcagttttagcttgcgtcaaggccgtgtcagccgcgtccttagccgtttgtgctttcttctcggtagctggctggttggcgatagcgactttgttggccgcaatttgctgttggtcagcaggaatttgcgcttcagctgctgccatttgcgacttagtagcgtcaactttagtttcagcctcagccatgacttgattgttagtatcaagttgttgttgtgcgcggtcaacttgggctttaccagcatcatactgggactgtccaatcgcaactagttgactttgattagtcacttgcccctgtgcagtcgccactttagcttgtgccgtgttgacttggttttgaaccgtggcaacattccccttggcagtctgcacgttggcttgatactgttgctgactagtcggtttgaccgttgctaacttttcgttagttgccgtctgagcgttcccctgcgtggcactcgtctgattcgtcgtatcgctgttgtcagttgccgtgtcggcctgcgcattgttaacacccaattgggtccccacgaataatgccgcagtggtaatactggtatataataatttcttattcataagctcactccaataagttaatataaatatcattataaaccaatgatgccataatactagatggtgtttacacccttatatcctgattgaacattggaaagccttatttaatcaggactattatgaattttagtcgttgaagaagtcgcaaatcaggaagtaccattgttccaattttacagtataaagttattttgataatcaacaattgctaatcaaacattacctagttatcattaatagccactgttttcaaaaacaaacgaaactagtgtggtatatttctatccgattaacgacagtctttcaacaattcgtatcagattgttagataaacattattaatgacgttaccatgaccaattcctatctattattaactcagccctaccaaaacaggcagcgcccaaaatttggacgttgcctgttttaatcattacacatcgcgcgactaatacgcgaatgtcaaccgctatgtcgataggataacctgtgttaacgtgaaagcaaggtcaacatgccaaccatggctaatgaattattgataatgtgcaaggcgatactatagcgaatatcgttgaaccacacgtacgtaaaagtcagcacgacggcgatcggtaagtaggctagtagcgcagggctaaacgataatgtatgggcaagggcaaatactaaactcgcaaaaactaatgcaaccgtgaaactcacccaatttgtgacccgcggaaataaccaacgatacatcagcccgcgaaaaatcagttcttcgacaatcggtgccagtactgccatcatgacaacattaatgactggactagtagtaaataccttatccaaaatcacttggttttcaggggtttgtttcacgataagtcccgccaacatgttacctaactcaaccaggataaataggcccactattgttaacgccggacgcgtcggtcgtgataagctggtcacgattggcgcttgacgacgataaatcgttaccagccaccaaatgagtaatccgagcaagactaaacttgccactccggcaattagtgttgccgtggccgagaacccgtgtcgaattgctggcatcatcgtaggaatcatagcgagttgatatagtacgaatagaccaattagtttaacgatattgaggagccaggtgacaatagaacgattcgacttcaaaatttcccaacctccttatgtgtttgcatcagcttttcagctcgttttgggattagtccgccaagctgactaaacatccactagtgtccttgtcataataccataatgaagaccatttgattgtgaacaatcacctcttcagagtgaaattatgattgcactatttgaccagtctatcttaagaaactacaatcatcggaaaacagtgatcgttttaagtctaaccacctatttttaattatttatctgtttggagaactctgccgatattccaaatcatactaattctcaaatcattatctccgtatatattaaagtgagaaaagtcgtatctaaatctagtagcatcctaggaataaaaccatcatctagataacacttgatactaatctattttgttccaacaacctgaatgcattataattaacaagcaattaatttatatcaataaatcatgttttatattaaatagtttatttaaataagttatttcttaaattttttatttaaaaatataaattttacgtttaaatattatacaatacgttcattgggagactataacatgccagcaaaaacacaaaacaacttcattcgaagactaattaaccttcgtgacagtcggaactggtcgaaaactgaggtggccaggaaactagggttgagcagtatgcagcgatatgccaactatgaatatggcacgaatgagcccgatttgaacatgcttaaacagattgcagatctatatgatgtgacaactgactacctgctgggtgaagatagcgcatctaaatggattgctaaaaaagatactactgacttaaaagactttctcgcagctcatgtggattcaatgacatacggaggcgaaacacttacggaagaagaacgccaacaagtacgagtagcaatggccgtcatcttctgggaatagagctaaacgcgactaacaccccttacgatgaagtatcttaatgttcgaaccaagttacttcgggcacgcttatggaaagcttatttatcggccagaatattggtcacctttgtttatttatacgaaaaataaacaattccttgaaactagtcttttatttatggttggcgcgaattccgttgcggcgtgcgggcatggtggaccgtcaaattcgttagtgtggcgtccgttgctggtttcgtgaacaacggcatcgtctcttccaagacatcgctaaacgctaagccgtaccagatagcaggagatggggtgatgttttgtagtaggacgcggccaccaattagtagtcgatcgaactggcccatagttgggttgctagcaaggtccatgatctgctgattctgaacgacaaatttaaaatcgccaacttgacgaggttgtgtgattccgtaacgggaatattggggatcgatgctgtgatctgcaattaagttcgtgacaatttggcgcaaatataaattaatgtgctgtgatttacggaaacctaagttgagttgaacttccacgatatttcgagtgcctagcatgtcaatgctgtaactacaatcataaggtcggttggtttcattaatggtaataaaccagtaaaccttagcgcgtttaggccgcttatctaaaatcgagtacagaattgaccgtttaacccggtgttgatggtcgaccttagccaagtagactaaattcgttgcaaatactggcaggtgatcatcgtggcttagctggatcagttgattacgataatctagcagactaatctgttcatttgcctggttgtaacgcaaacgccggcgattaccaaagaaccaaacgaccataatcaagaaaatgacgagggtcagccccaaggtcaaatagccaccgtgaataaacttggtcagactagccgttagaaagacggtctccagtgcgccaaagccgaataataaagctagcgccagcgcccggtggcccttcatgtgaatccactggctaagcaggatggtcgtcatcaacattgttaaggtgatggctaaaccatacgccgcttccatgtgagctgaagtttgaaatagccaaacgattcctaaggtgaccagacataacagccagttgatcgcaccaatataaatctggctccgaacgttactggggtgcttgataatcatacgtggtaagaactttaaaccgactgcttcgtcaactaaggtataagagcccgtgatcaaggcctgtgacgcaatgatggctgcggccgtggctaagataatcattgcaatttgaccacccgcaggaaccatggcatagaacggattgacattggtggcattgcgccatgccgcatcctgataatgggttaacatccacgcgccctgaccaagataattgagaatcaaagtcgtgtatacgaacggccaagtggcgtcgatgttggctttaccaacgtgccccatatcagaatacagcgcttcagccccggtcgttgcaaggaagacactaccaagaatgaaaattcccattttattagccggattgaataagacttgtacggcgtaaacgggtgagaaagctttgagaatgacgggtgcttgactgatgttgatcagaccgaagatgccgatgacggtgaaccagagcaacatcatgggaccgaatgaccggccaacgacggcagtaccaaacccttgaatcataaagagaaccagtaaaataaccgtaacggttagaggcacgagccacgggtactgggaaaaagcccccagtttgggtaatccctttaagccttcaactgctgatgtgactgtcacagcaggtgttagggtgccatctgctaacaaagcggcgccaccaatcaacgcgacgaaaattaaccatttggcccggtgacgaaccagcgcatacagggcgaaaatgccaccttcatgatgattatcagcgcgtaaagcaatcaggacgtactttaccgttgtaatgagcatcaacgtccaaaagattaatgaaatactgccgataacataatcaggtgttgcattcttaagttgccccgcgtcattgatcagggcgttcataacgtatagcggtgacgttccgatgtccccgtacacgacgcctaatgtgattaacatgccaatcaatgaacgttcctggatccgttgcttacgcatgaattattgacccccacttcaattagaactgtgactcatactatactagcttttttcaaaaggggttaaccagacaaactaaaaatttgctcatgttaacaagtttcaacttacgtttcgttaggtgaactttacttcaagttgagtacaataagtaatccggttgtttgtatttagaggataaaaaatgagccgtttcattccagttgataacgctgaaatgaaacggcccattagttttgaatttattagtctagtcaattatttctcatcagtggctgtatctgtcttcaactgggagtatttaacggaatagccaaagtaaacgaccataccgatggctaaccataccacgaagcgaatccaagtgacaggcttcaggttgattagtaggaagacacaacagatgattgacatgattggtacaaacgggacccatggcgttttgaaaggacgccgaagatctggttgtgttttacgtagccgtaagattgagaaggaaactagggtaaaggcagtcaaagtgccgatattcaccagttcagctaagtcagctaatggaataaagccacccatgattgcggcaatcaacccaaacaagacggttgatttaagtggtgcaccggtcttagcgctaatatcgctaaagacatggggaagtaatccatcccgcgacatggagaaggaaatccgagtttgaccgtagagacagactaacattacagtggtcatgccaagaatcgcgccaaggtcaatgattccggccatccaattttgaccagagtaactaagaacggccgagatcggatgatcaatgtacttggcaaacgtttcaaatgggaccacgccagtcatgatggctgatacagccacgtagagaatggtacagataccaagagacagtaacatggaacgtgggagtgttttggatggttccaatgtttcttcaacgctagatgaaatggcgtcaaaaccgatgaaggcgaagaaaacgctagaagctgcgccgaatacccctttgaagccaaacggtaataacggactccagtttgccggcttgatgaagcgcactgcggtaaagatgaataaaagaacaacggctaatttaatcactaccatgacgttattgacgcgtttagtttctttgaccccgagagacaataaagtggtaattaggataataatggtgaaggccggcagattaaaatagctggtcacaccagggacggaacctgcagctgccgacaaagcagcgggcagtttgaggccaaagcccgccaagaatgattgaaagtagcctgaccagcccgctgaaacggttgagacagcgaaaaggtattccaacatcaagtcccagccgataatgaatgcaacaatttcgccgagggttgtgtaggcataggtgtacgctgacccactttcaggcaccatcgcagcgaattcagcatagcagagtgaagcaaacaggcaagcaattgcagctaagacgaatgagatcattaggccgggaccagccgtcaaggcccccgtaccagttaaaacgaagatcccggtcccgatgatggccccaattcccagcatcgttaggtcaaatgttttaagttcctttttgagcggactgtgataagtggctaacatggcattgatatcttttttgcggagtaaccgcgtgtgtgataaatccataatcatcgccccatttcgatgtgatagctttagtttaatcggttttgacaaagttacgatggtcaatccgaccaaaataaatattctgatgggctatagtgactaaaagccaaataattggacgcaatcgcgcgacatcctgcgacttcttattgattgtctgactaatcgtgattaattagctacggtattcaacgcctattaatagggtgatatagcgaacatggcgggggttgtttttctgaaggttaacttaccttgtgattgcgattgcgattgtgagtggggattattgaaggaccttaggaaatatggttttggctcactaaatcgccacttgattgatgcaacctgaagaactggagagagtgagcggcttattggaacccttttttattgatatcgattatatgaataaaatgggattatgattatccttaaagtattttgatgaatcaaatttgataattaattttcttgcaggtaaaacagcctacgagagactgatgtaattcgtctcgaccttccaatatcaacatttattgaccacatttacataaattttcttatgccaaatacaatcttgattgcaattttgaaattagcaaatacgaatgatgttcattagttggtgacaatgggtttggcgtttgctatattcaaaaggagaacgcaaatcaaggcctgaccaatattaaaggccacttgaaattagtggactactgggtctgctgattggtttggtgttggtaataaaagtattgatactagtacgtctgcattcataatgtataaagcattgccagactatttccagataataaagttgggaggcattagtcatgtcgtcatttcttaaagcaaagaccgttacacattacgtactttttgcaattatccttattagtagcttctgtttatacgggtacgttaaaaatcgtattgagttaaatcaagcgaggactgtactaacaacaatgttaaaaagcagtccttatgacgtgcgtgtctcgagaaacacaatcatcaaggaagaatccggcccttttagcggcattattcggtatgaatacacatttgcaaccagccaaacattagcggaaagtaagaaatacaaaaagtttttgcatcagtcatcaaaaaatatgaccctgaaaaattgtcccatcgtctatcgcgtaatcgtcagaccgccgactaaaaaaatcaagcattggacgggtgaaatctatctcgataccaatcaaaaactcagcgcaacgggacgttcgaattacgtccaagccttaagcgccaagtctttgcgtgaactaacgatttcataaaaagcccttaaccaggtggcgccaatgatttagcttactatcagcctatattgaaaaacggggcaggtaatgcgttagctcaatcaggccatacaacagatgttcagaagaggtagtcgaatcgagttgtgttgattgtctaatcaacgcaactttttatttgatgatttaacttggtcaaaaatatttgttatgagtttctccggtggtagcaaaggtatactgcaatgattgaataaaccgattcgtaaaataaagacccacgaaaaagcagctggaagactttaccagctgcttcaaagatttgatttattaacgatgtcgtcgatagtaacggtagacgaccgctaataaaataataattagtaaaataccaacggccgctcgcggacccgcaatgtgttcggttaagtgaaacatgcgaatggggccgagaccgtgaattccaagcattgcaagcattgaacgcgccctccttaagcataattattagctatttaatgattaaatgcaaaaattatattcgcaaaagattattatctcactactatctgcggtaaaataaaaccatcattaataaattaggtgggtgcctccattgcaatatattcagccaattttctatacaattatcgttttaaacgcggccgcggcgttcattaccgtgttccgggatcgcaatcgggacatcgcggctacttgggcttggttactcgtgttgatttggttgccgattattgggtttatcgcgtacgcctttgtcggtcgtaagttaccgaaaaaccggttattccggttacgtaaagagacgcaaattcgactcgaacagatgattcagcggcaacgtgaagcgctgggaacggaattgatgcccgcagatgcggtcactagctcggttcgtgggatggtcagtttattcttgaattccgatggcgcgttactaagccgtaaaaaccgggtcaaaatttatacggatggacatgagaagttccatgcgatgtttcaagatattgaggcagctaagaatcacattcacattgaatattacacattttataatgaccagattggaaatgaattattacacctattagagcggaaagcggctcagggcgtcgacgttcgtgtcttgtatgatccgtgggggtcgatgggcacgttccgcagcttctttaagcatttagaagaacttggtgggcatgctcgaccgttcttgggtgctcattcagcgattttggacttccgtctcaacttccgtgatcaccgtaagatcgtggtaacggatggccgggtcggctacgttggtgggtttaacgttggtgaccagtaccttggtcgtagtaagaaattcggttactggcgtgatacccatttgcggatcgtcggttcaggagtttttgagttgcaggaacgtttcattcgtgattggaacgccactgatgcggaacatcgaatcgtgccagacgttaatatgttcccagtcattcgcgttaaagggaatacgtcgttacagatcgtctccagtggtccggacagtgatgcgcaacagattaaattgggttatattaaaatgattatgacagcgcaacaccgtttatggattcagtcaccatacctaattccggacgattccgtattagatgcgattaaaatcgctgcgatgtcaggggttgacgtccgcattatggtgccggacaaacctgatcatgcctttgtttaccgggcaactcagtactatgcccgggaactggcagatgctggtgtaaaaatctattattataataatggttttattcatgccaagaccatcgtgattgatggtcaggtggcgtcagtgggctcagctaatatggacttccggagctttaagctcaactttgaagtgaacgcctttttatatgatgctgacttagcacaagaattggaacggattttcttagaagatcaaaaaatcagcagtttgattaccgttcaagactttaaaaaccaatcattctggttgaagttcaagcagacgttctcacggctgttatcaccaattttataattaaacaattgaatagatgatgccaaaaaactggttttggaaagttaatgactttccaaaatcagtttttttagtgttccctagtcgttcaagtacaattggcgcaaattattaatatccgcgacggataacccaagcacttctcgtaaataaccaataccattgccgtagaggtcgtcaaagacccgaaagaccatcttcatattgtcggcttcaacagccatggcaacgttgaattggctagctaggtcaccggcattagccttggtaatgatcgtagcggtatccatactgtctgcggccatgaagacggcgttagtgagcaggtagtcctgcataatcgtttcacgggggacgtccagggccgtcataatgagcgcacccgcgacccccgttcggtctttaccagcagcacagtggaagagtaccgattggtcgggctggtcgttggcgaggagggtcgcgaataaattttgccagactttcacggcatgactatccgtaatcatttgcgagtatgtttgtgcgttgaaggaatcatcgacgaccattcgcttgatgagccgttttaaacggcgatcaaagcgacgattgtcagtgaacggatagacagacgtattaatatacttagtattcttgggataacggtctggagacatctcagcttcattggcttggcgcagatcgatatcataacggagtccgtagttatccaagtaggtgagatcgcggttagtgagtagtgacatgccaccgcaacgcagcagtttttgccacttgattgtctgaccagcggtgttctcataaccccccagttctcggaagttgatgccgtgttctagtcgtaagacccgattgtgttccatagtctgattacctcgattagtgatttagctttattataaccgctttcattgccggtgtcagggtaaagtgggtgcaaaaattagaattggatactaaaaaaactgtcagaccagaattggctgacaagtttttttaggtattagtgagacttaattagtccccgttgtaaatcgaatttttaactaccacatagtcgcacttagtaatggcctttaaatcccggccaccggcatatgagatggatgattgtaagtcttcttgcatctcgtttaaggtgtcgactaagcggccccggtaaggaaccagcatttgtttaccctcaacgtttttatgttcgcctttttgagtttcactggcggaaccgtagtattgcttataagtcttaccatcgatttttaaaatgttgccgggtgattcttggtgtccggccaacattgagccaatcatgaccatcgtagcgccaaaccgaatcgacttggcgatgtcaccattggtccggacaccaccgtctgcgatgattggtttgcgagcggccttagcacaccaccggacagcagctaattgccagccgccagtaccaaagcccgttttgactttagtaatgcaggccttacccgggccaacgccaaccttagttgcatcggcaccagcattttcaaggtcgcgaacagcggctggtgtggccacgtttccggcaattacaaaactatccggaaggacgtctttgatgtgtttgatcattgcaatgacactgtcagcatgaccatgtgcgatatcaatcgtgatatattctggcacgatttgattagcagccaggtcgtcgataaagtcatactcgctggacttaacaccgaccgaaatagatgcgtacagttgcgcggcatgcatcgcttcaataaaagcacggcgggtctcgggggcgaagcgatgcataatgtagaagtagtcgttagtggcgagccacttggcaatctcgtcgttgatgacggttgccatattggcaggcaccactggaatcttaaaacgacggccacccaattctacggtcgtatcggcttccgaacgactattaatgacacacttgttcggaattagttgaatatcttcgtaatcaaaaatctccatgcccatgatgcaaaactcctttaagttaattcacggtgtcgcgttcaattagccccaaatgttgtgatcgataacgttagtttgttcgcgatcgggaccaacagagaaggtggcaattttaacgccgacgagttcttctaatttacgcaagtagttctgtgcattagttggcagttcctcaaaggttttaacgccagtaatgtcttcgtcccagccaggaagttcttcatagataggtttgcaagcttctaattccttcagactagcagggtagtgatagatggtttcgccgtttaagtcataagcggtacataccttgatggtctttaagcccgtcaagacgtctaagcagttcaaactaagatgagtaaacccagaaactcgtttagcatgccgtaatacaacgctatcgaaccaaccaatccgccgaggacgtttagtaacggtcccatattcatgggccgtttcgcgaatgaaatcaccgacttcgtcaaagagttcagttgggaatgggccgtcaccgacgcgggaagtgtaggcttttaagaccccaacacagttatcgattttagatgggccaacaccgctcccaatagtaacaccaccggcaactgggttagatgaagtaacgtaagggtaagtcccttggtcaatatccagcatgactccctgagcaccttcaaataggacgcgttgaccgttatctaacgcatcattaatgacaacggaagtatcggtgacgaatggtttcaaagtttgaccataagcgtaatagtcatcaaaaatatcttcaaatttcagtggttctaagtcataaagcttggtaataatttggttcttttcagctaagttgcgcttgagtaacgccgcaaaggtgtccttatcaagcaggtcggcgacgcgaatcccgattcgttcagccttatccatgtaggctgggccgattcccttattagtcgtcccaatcttgccaccggctttagctttttcttgagcgccatctaatgtgatgtggtaaggcaagatgacgtgtgcccggttagagattctaaggttgtcaggattaacgcccttgtcccgcaagtattgtaattcttcaactaatgacttgggatttaagaccacgccgttcccaatgacagctaacttatcatggaagaaaatccctgatggaatcagccgtaatttgaaagtttgcccattaaatacgatggtgtggccggcgttatcgccgccttggtaacgtgataccacatctgcttcctgactcaaaaagtccgtgatctttcctttaccttcatcgccccactggctacctactactacgactgatgccatattcttccacctcattaaatagtttaattatgaataattaatcctaaagagtagttaaacgttcaccactccaacaggaaagagtatagcaactttaacgtcaaaacgcaacctaaaaaccgaatgttcttgttttaagcgcaaataattgttcacaatttaggcggattagttcgaaaacaagtccttaatatggaaacgaagtgaaaaacaatagtattttttcattgttcgtctctattaattacttgaggggtatgctataataatgttcgtgttttgttagtgaatacctaaaaagaaatgaggattagcaatgattgatcgttatacgcgtcccgcgatgggcaaagtatggtcgttagaaaatcagtaccaagcatggttggaggtagagattgctgccgacgaggcctgggctgaattagggaagattccagcaagtgatgttgctaaaattcgagagaatgccaagtttgatgttgaccggatcgcggagattgaagccgtaacgcatcatgatgtggttgcttttacgcgcgatgtttccgagtcgttgggtgcagaacgtaagtgggttcactatgggctgactagtactgacgttgttgacacggcgcaaggttaccggttgaagcaggctaacgcgattattcgccaagacttacaagatttacgggcgacactagcacaacaagcgaaaaaatataaatatacggttgaaatggggcggacacacggcgtccacgctgaaccaaccacatttggattgaagattgcccggtggtattctgaaattaatcgggatatcgagcgttttgaacacgcggccgcaggcgttgaagcgggtaaaatcagtggggccgttgggacttttgcgaacattccaccatttgttgaagaatttgtctgcaaacaacttggattgcgcgcacaagaaatttcaacgcaagttttaccacgggacttacatgccgaatacattgctagtttggctttgattgcaacaagcgttgaagtgtttgcaaccgaaattcgtggtttgcaaaaatctgaaactcatgaagttgaagaattctttaataaaggtcagaaaggctcatcagcaatgcctcacaagcgtaatcccatcggttctgagaatgtgacggggttggcacgggttattcgcggccacatgatgaccgcctatgaagatgtgccgttgtggcatgaacgggatatttcccactcttctgcggagcggatcatcttaccagataccacgattttagtggattatatcttaactcgaatcaataagattattaagacgctgacggtgttcccagaacggatgaagcaaaacatggatgcgacttacgggttgatctacagtcaacgggtcttgctcaagttgattgatacggggatgtctcgtgaaagtgcttatgacctcgttcaaccactgacggctaagtcatgggatgaacagttacaattcaagccacttgttgaaggtaacgccgagattcgtgaacatttggatcaggctgcgattgatgatgcgtttgactatcattaccatcttcgccacgttgatgatattttcaaacgattgggattagacgattaaattaaaaatgatgaagaggctgtgacataagtctctagaaacaaagcaggtctggaaaaatcttcgaatttttccagacctgcttttgatataatagaaaataaaaaaagagcatcggtcgcacccgatactctacgaaattatcctcgaaaggacattcctaatatgcaagattattataacatgaatcaaaccactttgagtatcgccttggattaccaaccagaagagcatcattctgctcgttacatcaaccagcttgttgagagtttaaaactaaaatatgattaccagtttggccgtccgcgggaatataacctcggtgccatgttaaaactggtccttttagcgtacagctatggcattttcagcagtcgtaaaattgaacagtttgcccgtggaagcaactaagcaggtttccccgaacccagccaaacagcaacgccggactgttaaatcacaaaaacgtaagttggacaaacgacgtgataaaatgcgtgaacaccaagcacagcaagcaatctatggtcagcgtaacagctactctaagacggatcacgatgccacctttatgcgggtcaaggaagatccgatgcaaaacggtcaattaaaacctgcctacaacgttcaaatcgccacgagtaatcagttcattacgggatatcggcttttccaaaatccaaccgacacacgaaccttacaaccgtttattgaacatttaaaggccaacaatgtgttaggtcacaccatcgttgccgatgccggatacggttccgaaagtaattatcggtacttggaagatgaattcggtcagcataccgttttaattccatacggcacaatgcttaaagaatacattgccgaaaagtatgatgaaaatcatcaactaatttccgcggcactaacaccaaaaggatatcttaaaaggatttccgtgaacgaaaattgggaatatttcaaatcgaaacaacgagaattactttcagctccagaaactggtcagatttacgctcaacgtaagatcgatgttgagccagtttttggcaagatgaaggcttctttacatttcaatcgattctcggtgcgaggtttcgacaaggtcaccaaggaagccggaatcgtaatactggcgttaaacattatgaaactggtcacggtagggaccaactttaaaaatcaaaggcgtaagcaaatgggacgagaaaccaaaatttggtttctcgtcccatttacttatacagaggctagttatgtcacagcctctttttattaggggaagtttatttcggcacgatgattcatactagctaattttgagtcaacagtatataatgtaatacgatggtaaacgaacggagggatataatgagcacgaaattaattaaggataaaactgtgtcaacgcgagtaactgcggatattagtgaacgggccaaaaataacttggctaaacaaggattgactatttccgagtatattcgtttgtccttggtcaaggctgcgaacaatgaagttcggttagttagcttcttagattctacagaagcattagcagccaagagggaggctgaaacagggcaagtgaaaacaattggtacattaagtgattttgacgattggatagataagttagatgaaaattaaacaaaccgcatcattcgaacgtcagttgaaaaagttagctaagaaacattttccggttgcggttttaaaatcttgtttaaaggcaatcactgagcatgatgacgctgtcctaaagcggattaaagaccacgcattaaaaggcaagtggcaggggtatcgtgaatttcatcctgcaaggtacggtcattacagcaaaacatatgatggctggattgttatttatcgtttagaacaaaatgaattaatcttattattagtcgcgacaggttcccatggagtgctgaatcaataatcaaatatttttgatcgtagtgaattgacatgcaatggagagcgttcacttgtagttgatggctttggtagcgacaacttaatcaatagcgaagtgcttggtgctggcgtgccaggcacattttttatgcacgccctcattgtatatacatatatatgcacattggtgctattttagtatatactatagtcatgaatatgagaaagggtggtaacttatgagcaagctggtgacattgagaaagtcaggcaacagccttattttaacggctcctgctgatttgaaaaatgaagttggccgtcaatactctgttgataagcgatcggatggctctattatttatcagccaacaaccaaaaagaatatttttgataacccggattggctacagtatgactaccaaaaggacttaacagaagaccctgaattacaaccattgaatcctgtcggaaaggaacgactagaagaatgaaatttccagagcagaaagatgttgttgtagtggatgccgaactacattctggtaaagaatacggcggacatgcaccgagtgctggtaatgttagacgccatatggtggttatgagttctgacagttacacacgggctacgggcatgatactagccatgccgattacgacagcacagcggtacatgaataacccccggtattttccaattctactagccggtggccccaaagatggtgttaggggatttatcgcattatggcagttacaaaactttgattttgtatctcgtaacggcagggtggttaatcgtattaacgacaagacttacaaggaaatccttccttatgttaaagacatgttggggttgtaaattactataattgaatcatcaaagtgcttggtgctgatgcacccggcacttttttccacgtgattcaattggcgaaagaaggtcaacaactcgggatagaatgtcttgtagtcaattttgttgccccaattgtcgacagtccatgcttcgagttgttgctggaattgttgcgcttgagcttgcaattcagcgggtagggcgggcttatcggcagtttccgcggttcgcataaacttttgataagctgaaaaggtctccataccttttttggtcactatatcatgaccaatcttattagccagttcttgttcagcctgtgctaaccgttgtttcatagtgggaatatctaaagcctttgacataataaccgctcccttgaatcacgcgtatttacctaaatcttttataaatggcgattaacggctagtaaaataaacgatactttccgtgagtatagttagaaactactactagattgtgttttgtttgctctacttgataattggtattagctttaataatatttgttcctttgcttaggacatgcgtcgatgtgccattaattataggtgtgccaaactgatttggtgtgactgatggcccttcatataaatgccaattagctattgataatgagttgtcagttttagcttgtataataacatttgcatggtattcatttttcttcaaatgttgtcccgttacttgcagagataattttttagagattggcacgaatttgtttttttaacatgtatagtggtgatccgaaatccttgataatcagattcaatattgcttttgtgccaaaaaagaaaacatgtaaccccgattagtataactaaaccaaacaatattgctttttttctattcattgttgatcttcctctcgagtgactttaccatcattaaaataaagcaatttatcactaactgattttagaaacatagcatcatgactagacactaaaatagtttttccttttgctttcaaatctgtaatcaggttaatcataaattgttgtccgtcttcgtccaatgcattagttggttcatcaaacattaagataggtttatcgccaattagagcggacgcaattagtaatctctgacgcatacctaacgaatagtcttttatttttcggtcatctgttggatttagaccaacataagttaataattcaatttcattgtcttctttagtctgaggtagtaaggataataatttaagattagtcaggccgcttttatttggaagtaaattgtattcggaaagtgcaaagccaatatctttagcgaatagactatctgtacgtataacgctagcattaacaaatacttgcccactagatggtttcacaaagcctaaaatcgttttaaaagtaagtgttttcccagatccattaggcccactaaaaccatagactttattttcatcactactgatatttatgttttcgaaaattgcaagaacaagttagccacggaaaacagactagtactttccagtatcaagatgttatctaaagctggtgctgagctttgccagtagcgcttggcagtaggaatcggatggttgattggtaatcggctgattataagcggcatctactaaggtaaataatttttgatcatccacatccattgttaggaccaacctttcaatcgttgagataggcgcagttatagcatggtcagtatgcttgatacgcaggcccaacttggtttctaaagtaatggaacgaacataactagagccgccaatgagtcctactcattggcggctctagttactaataaggggttaatcaagcggtggtatttgttgctttaggcccggtgccaagctgcgtagccgatggttgggaaaataccgattaaacggtcgatttgttcacggtctaattgatattcgatagccggcagtagtgcgttgacggcatcttcagcttgatcactgatttcagtcacgccaacgagatggccgtcttggtcatggacctgtttactagcggcaatcggttccttggagacttgataataccagtaatctgctaaatcgttatcactaacggttaatccggccttttcagcggccggtattttcatgccagcttgcgcaattcgtggtgaagtaaagacgaccgatggaattaccggatagtcaatgggcgcactggtttgaccagagaacaaacgcatcaagtatttggattcaaagtaggctgcaggtgtaacctttggcaagtcattggcaaggacatcaccggctgcatagatgttaggaacgctggtttgcaagtggtcgttgacataaacgccgtggcggtcatatttgataccaatccggtctaagcctaagccatctaagtttggaattcgaccagtcgcatctaggatccagtcggtcgttaattgctggtggtcgccataactaacttggaactggtcatcctgtttggtaaatgcttgcacgttggcatttttgatgaaggttaccccacgttcggttaagtcgtcaaccacttgtgcaacgaatggttggtaaaaatcacggagggcctggtcgccatgtaacatgactgtcacttgggcaccggccgcgttagcgatggtggcaaattccataccaatatagcctgcgccaatgatgacgatactttgtggtaaccgtttaaggttcataaaatcactactatcgtgggcgagcttggtccccggaatatctaaacgatggggctttaaaccagtcgcaataacgattttttcagcagtaatggtttgctgatcatcaacgacaacggtgtgagcgtccttgaacgtggcatgaccatgaatgatcgtggcgccaccatcttccaaacgagctgtcaggcctgctggtaagggatcaataatctcttgcttgtgggccacgttggccgtccaattaatggttggtgcactgctcaaaatatcattgaggcgcgttgcttcccgcgttaatttgacaggttcatcaagggtgatcttggcgttgcaaccacgattggggcaggtgcccccaatcagaccactctcaatcacaccgacgcgaacaccagtcttggcgagtggtgcggcgccatcaaacgtggcgtgacccgcaccaatgtataacacatcgtaatcgtatttgtctgtcatgatttatcagcctccattaaaattttggtaacttaagcttaacgagttttaagaaacctgacaactgatatgaattgctcgcgccgactgtaatgattatactgaaagtaattatgtcaatagggagacgttaatatgcatgctttgatcgcaattgattcatttaaaaattccatcacgagcgttcaggccaaccgaatagtggctgaacgatttgcggctcacggaatcaccgctactcaagttgcaattgccgatggtggcgaaggaaccgtagcggcgtggttggctaatcatgctggtggccaagctatcacggcatcgacggtggatctggcacaacggccagtgactgcaacgtatggctactttgccactgaaaaaatggcagtaattgaggttgcggctgcatccggaatccagtttgtcacgacgaccttgacgccgttagcaacgaatacctatgggaccgggctactgattaaagatgcgattgagcgtggcgcccggcagatcattctaggcttaggcggtagcggcacggtcgacggtggtgccggaatcctacgtgcgctcggttatcggttttgggctgccgatggtcaggagctagccatgactggcgctgatttaagtcgggtcgctaagatagacgatcgacatgtgttgtcacaattagcggaagtctcgttcatcagtgcggcggacgtaacgaatccgctaacgggacaaaacggcgcagctaagatttttggcccacaaaaaggattaccggttgctcaaattcagactcacgatgccgctttagctcactatatgacggtcgcagctggtgcggtgagtgcccacgaaggcgatggggctgccggtggtattgggtttgcattacgttactttttacacgcccgcgttcgctctggttttcaattgttagctgaaatgagcaatcttaaaatgaaagtggcccaagcggatctagttatctctggcgaaggccaagtcgacgatcagagttttatgggcaaggtgccaattcagctcagtcagttagcccaagcggccggcaagccttgctatttattagttggtcggcagaaaggtgcaaatgaaacatttgccaaacagggggtcacggccgttttaccgattgtcgatcaagtcatgaccttagatcaagccatggcgcagggaccagccaatctggaacggatggcggaccgcttagcccggatcattagccagtcataaaaaaacttaggcggtcaaaaaaccgtatgcgcagtgaatagcgcatacggtttttcgctgaagcttagttgtcaggaacatagtgattcaaaaaggctgtaacatgtcgttgatactcggcaggatcgatccaaaaactctcggcgtgagtggcgttgggaacctgccacatctgcttggggcccttagcggcctgataattttctttgagcatccaacttgggacgtagacatccttatcaccgtgaatgaagaaaatcggtagatggttatgtttgagctgttcgacagaactgacgtcgcttaagtaatagcccatgcggtggcggttaataaaactaacgatgggcacaaacggatactttggtaagtgaaactgccgctttaataagtaagcgagttcttcttcgatactcgaataaccacaatcggcaatgatggccttaacttgtggtgggaggtcttcgccgctcatcatttcaacggtcgcaccacccatgctgacaccaaaaaggatgatatccgtgtgacgaccattgatacggacgactttatcgatccagcctaaatagtcgcggcgatcctgccagccgaagctaatgtacttgccggcactttgcccatggccgcgatcgtcgggcaagaggacgttgtagcccatttgatggaacatataagcgtaatttgccatcgtttcaccatcgcccttgtagccatgggaaataataacggttcggttgctggttgttttagcgggaacgtactgtgcgacaaggtgattggcctcgtcattagcgttcagttgccactgttgtatgggctggcggtgtagccaatcgacgtaagcgtagtaggcatcggcgtatttttgcttatctgccgaagtttcgggcacgtaatcaacgcgcttgaatgcaaagttgtagagcttctcactcgcaagtagggcggccgaaaaaattgccacaggagcactaattccggctacggcgcgtgtttttttcattaaatatcactcctctaatctctcaataatatgatacgccgattagaagtgagatgtaactatattattctagtaatataaaaggccatcgcggcgggcgatgacctataaattgcattggtcgctaggtggcatccccagcgagcctgtttttcattaactttggaggagtaaatgaaaaaggttcaagtggctgaaggagatgtccagtcactatatgtttagtatagtagtttgattgttaaaaggtaactaaatcgcttacttgactggtgaaaaggctaaaaattgtttgtgggtggtcaatatttcgtcgtggacggatttgctcgtgccaagtaggataccgattcaagtcgcattaagcctccttaagggctagttcatgcattttggtgctaacttgattaagaacctgtgttttacgttcagctgtcaaaaagacgcgctgacttagaattggatagtgttgttcacgggcgattggcaataattcacgataaaacaaggtggcggctaatagcgacggccgggcgacgggatcaatttgtggcatcatggttaatgcagcctcgtacttgttcatggcaatctgtgcttcatgttcccaaagccgaataaagttggcggatgggagggggccatgcaagtcagtcggcttgagttgatagtgtgccaatagttttgatggcaggtagatgcggccacgttggtagtcttcaccaacatctcttaaaatattggtgagttgcatggcgatgcctagttccacggctggtttgacaattgattgcgggttagctgttagcattggcaaaatcatcagaccaaccgatccagcgacgtaatagcaatagtcttcaagtgcttgctgagtttgcggttgtttaaaagtcgcgtcttgttcttgaccagtaagcatatcgaaaaagacgtccagattcatctcataagtctcaaagacgacggccagtgcgcgccacatggggtggtctgggacatgaccattggcaaaggcggtcaatgattggtgcaatgccattagaccatcaatatcatggtcaacatcaacgaggtcgtcggctgttcgacaaaaagcataaacggcgtaaatactccaagcgcgttctagtggtaattgcgagaaggcggtgtagaatgcgctagaggaccttttagtaattgtttgacagtaatcaaagtcagtgcgatgttgttcgaatttaggcattagtttggtcatctttaatcaactccttaacggctaatttagcactttgcataacaatgggaacaccggccccagggtgggtactactaccacaaaaataaagatggtcggcatagtcgaacttgttatggggacgataataattactttgctttaacgtcggtcgtaagccgaaagtagctccgttataggcgccaaactgttctttgaagtcaaccggtgtaaactgcttttcgacgacgatatgctgttcaatatcgctgaaggtagccgtttgtcttagtttgttaatgattagttgacgatagttcttcagtgttgttggtgaccagtcattaaactttgagagctcaggaactggcactaagacatagagtgcctcactgttttcgggagctaaacttggatccatctttgatggaacatagacatagtacgagggatcttctggtaacttgccgttgtcaaacagatcggcgacgttttggctgaaatcttgtgcaaagtggatcgtgtgtaatgcttcggttgggtatttcttgtctagtcccaagtacaagacgagacatgagcatgaataagccattttggcaatcttttgatcggtgtaccgaccacgatcttgctcatttggaatcagtgtcgtcatggcggttggaaaatcagcattacataggacatagtcactgtggatcggatgattattgacacgaatgccgacagcaactttatctttgatgataatttcttgaactggtgtggcaagctttaacgtcccaccttgttctttgaataacttaacgagactattgacaaccgtgtacataccaccctttaaaaaatagaccccatagaagagctcaatcattggaataatgttgtatagcgacgggccctggtagggagaaatcccaatatacagtgtctgaaaggctaatgaattacgtagattctcattcttgataaattttgcaatgtttttgtaggcattgttaaaggtgcgtagctgtagtcctgcatacagagcgggtaggttataaaagtcacgccagttacggaatgattgttctaaaaaattaggcttcgcgatggtataccggtgataaatatccgctaaaaaatttaacataccattgacgtcatcaggcgcaatgcggttaatctcggcaattaatgttgggagatcgcgtgacaaatctagactagattgatcaccaaagacaaggtgcatcaaaggttgaacttcttcgaatggtaaatagttgtgcggatcgaccccgcaaaagcgaaagacttcttcgtagatgtctttcatcatgacgatcgtcggccccacgtcaaatgtaaatccttggctaacaatctggttcattttgccacccggttgcgcgttttgctcataaatcgtaacattataacctaatttttgaagccgtactgcagcggttaagccaccaataccagcgccaataatcgatacttgcttcatcagtaaatctcccccttaacagatgaataactaaaaagcatggttaatcattagttatattttggtttaataatgtaaaaagtacaataaatatgattactatgacgtattaaagtagtcggtaggtgcgaatagagcggacgagaaaaacaaaaaaaccaccgtatcggggaatacggtggaaaaaggagtagggtaaacatgtgacggggaatcacatgttactatgaatttcattactttggaggagtaaatgaaaaattttaggttgtgttatagctgattgagttaacctcaattgctatgatgtaatcataccgaggttgtgtgaagaatttgtgactgaacatggcgaatgtcatgaaaaaaagggaaaggctttattaagaagtgtgaagaatcatcaatgttcttaagaaagccgtggcgatacgcatcggcgcaggcatagttaagtgcccgggcaaaagaaaatagtcatttcaaaagtgtgtatcttttgaaatgactatttttgcctgcaattcgggctcgtcaaataaggttgcggtgatattaagttgatcgtgatctgtagtagttgaccactgactaccggtacgctatgtgattagttatcgtcacgattaccaccgaatagaataattagccgtagtaattgtaagaatgtggacaaggctgccgcaacataggtcaacgccgctgcgaccagcactttgcgtaccatgggaacttcgtcgcgcgtcaagacttggccatcagataagatctggagggcgcgtcttgaggcgttgaattcaactggaagcgtgacaagttggaacaataacgccactgagaagagcaaaatcccaatgtgaatcagtgtttggttgtaacttaataaaacgccgataatgattagtggtaatgacaagcttgagccgatgttcgtgatgggcacgagggcggtccgcaagcgcattggccaatagttaacgtgatcttgaacggcgtgtccacattcgtgagccgcaactccgatggcggccacggaggttgaatctgctgtggcttctgacaggctgagaatcttagtttgaccgttgtaattgtcggtcagatccccgctgatcttttggacaccaacatcattgatgccagattggcttaaaataaagcgagcggcatcggtgccggttgtaccagattgactacgataggcatcataatgccgaaatgtccgattaacgtagcccgatgcggccattgagatgatcagtccaatgatgactaataggtaagtcggatcaaaaaacgaatagaacaaggtcgaaccctcctaagtggtttaatgttaatccgattctatcagatttggcgtgacattcctactgaagaaagccattggaaagtgtctttactatcgagaaacgacgtcagattatataattagcccagttaatcgtaattggcaaagagcgaaggagttttctgatggaaaagacgtatcgaaccaaaacgtatggggaaatgccgttaaagttagatactgggaaaggctggatttttcctaaaggtgttgaagtgaaggcgcacgttgatttagaaacgggacaggtcagtttttttattgcaccagaagatctcgataagatgaaataagtattaggaccacgatacgcggtaaggttgagaagtttgtttctcgccttggcgcgtttttttagtggaaattggattggcaatgattatggttaatactgtgttcacgcgggggctacagctgcttgaaggcaataaaaaacctccgtatcggggaaatacggaggaaaagggaagtaaatcggtaaaatgtaattaagtacacacacatcattacttggggaagtaatcattaaagttagggggtcgttaaggattgggatttccttaatgactataaacatagtatagcggcgacgcgtgaagaaagtgtgacgcgaaaagtttaaaagcatgattttcagacgaaaaagttaagtcatggcacgacgaaatatgacgatttttacaaagtttataacgaaatgacgaccgtcagaaattgatataggtgaaaaaacgctgttataccggcgattgtggcgattctcggtttgggagatgctataataaagcacaaattaagtgaaaggtgttttccaaatatgacaattaaaatcgtcactgattcctcggtccaattaacggcagccgagattgcacagtataatattaaagtggttccgttactcgtggggttcggtggcgacttgattgcagatacggcagttagtaccgcggaatttgaccaacagatggcagtcagcccagtcttgccaacgactagccagccaccaattggtgatttcgtcagttgctacgatgaattgacagcggatggtagccaagtattatcactgcatttgacggagacattgagtgggacggtcaatgctgctcgccaagcagccaagcttgctagtggtgatgtgacagttattgatacccaggcggctgaccgtggaatggcctttcaagtgctgacagcagcacggatggctcacacgggtgcggatatggccacaattttggcgaagataaccgtcattcggcagcatactaagacctacttgttcgtggatacgctcgacaatttggtcaaaggtgggcgcgtccctaagttggctggcgtggtcacgaatttgattaaattaaaatttgtctttgaattagaagccggaaaattaaaactttatacgcgggggcgcgggaaaaaggcactaatcaaagcgcaggctcaaatcctagaccaattagcggatgcaactcgagtcgaagcggctggaatttcttacgtcggcgaaccgagcgttgcggaagcgccagaaaagcttctccaacaagtcgttccacaagtcacgccactggttgcgcgtactagtccaattattgcgacgcacaccggtgttggcgcttacgcgttgatgttttatacagttgattaaatttgacgaactaacctactattaaaaattactttgatgtgttataattaattaatgataaatgagaaccgtgttggtgcactgttctgagcctaaccaccatttaatgatgactagacccggatggggcaccttttttgtcactcttttcactaaaagaaagtaggaacttatgtgagctatcttctcaataatccgtttttcgggatcggactgtcgatcttggtgtatgggattggcgagtatttatatcacaaaacaaatcgctttgtgttattccaaccgttattttttggaatgctgctcgggattggtttattggtattgattgcgtcgattctaaaggcacccgtgcaaaaagtttatgaagcgtaccaggtcggcggcgactggttattctggtttgtggcgcccgccaccgtctcgtttgcggtgccactatataagcgtaatgatatctttaagaaacattgggatgtcattgtgattgcgttagcgattgggttaggtctgtcattatttggtatctatgggatttcacggttgcttggtctgacggatgcagcgttaggtgccatgttagtacaagcagcaacgacagcaattgctttaccggtggctgagtcggtgggtggcgatcaagccattgcggcgttcgcagtcattctgaattcagttttgatttacgcgttaggcgaccattttattcgctggttcaaattgcacaagaatccgctcggtgccgggttaggattcggaattgccggtaatgcggttggtgccactaaagcgattgaagtgagcgaggctgcgggcgcaactggtgcgattgcctttgtgattgccggtattcttgttaattttatggttccaggatttgcgcagttgattggtttaggttagatggtccgggagggattcgatgaaaaaaggcgcgtttattacacaaattgtgatttatggtttgattttattggctagtagtttaattgctaatttagttaataagatttggcccgcattcccaatgccgacaccgttgattgggatgattctactatacttgctgttaacgtttaaagtggtcaaacttgaacaggtagcgggtgttagcaactttttcgtccagtttatcagcttgatttttattccatcagggatcgcgttagtaactaagttagacgtgttaaaggcagaaggcgttcagattgtgatcgtcattattgtttcaacactaatgttgttgctttttacagcgggaatcgcgtgggttttaattcaagtcaaggaatggctcattgctcgtcgaacgaacagcaatgttgggttggaagaagattaaatcttggtggcacataatttactcgtgagtagattgggtaccagttggatctaatcgaaacaggcagttgttgaaccgcttgttttggctattacaaaataatagcaggccgttgtggggattgcagacccatgacggcttttttagacacaacaaaaaagcccgcctaagcgggctttgagatcgtattatggtaacgaaaagttccatgcgccatggccgcaatgcaacttttcaccaactaacaattagttgtttacttttacgacttgcttgccgttgtagtatccacaacttgggcaaacacggtgtgatacacgtaattcgccacaatttgggcatggtgccaaatttggtgtagccaatttaatatgaccacgacggttgcgtttacgcatcttagatgttcttcttgctggtacagccatcaacctacacctccttcaagtgaattcacataatgtgtgttttgatacgcctagctaacttaatccttgtcttcctgatcagggaacaggttttttaacttagctaaacgcggatcaacagttttaagttctgcagcttgcaacgcttggtcgtcctcggagagaacttcccaacccttaccagttggcattggggcgccgtcttgttcagcttcagaaagaatctgcatggggatgtgaattaaaatattatcctccacagcgacatcaaaatctaaaatatcatcttcaggtaaaataattaccgtatcagtttcttcgtcaaaacgactcagatccgttccctgaggaacataatattccgtcatttgaaaagccaatgggacatccactggcgtcagcgagcgactagacggcaatgttaacattgcgtcaatcttcgccgtgattaacacattatccttatcataacttgctaacccagttgcgtgaactgacttaacgtcgataatttcaggataacggctcatcaaggagtgttttaaatccaatgcttcatcaaactgaagtggcgtttcacggtatgttttaagctgtgaaagtgaccatttcatttaaaaacctcctaatgcaacgtgataaattatacctgtgtaaaaatcctttgtcaatgttttttccttgacagtccaaaatgcccgtcattagacctaaccatatcaggaaagtgcgctacggtcaaccaattgttgccggcaaccgccacggccgccggtacaaatcttgcgactgcccattaattaattgatagacgcgccccgcccgataatcgagattcagggcatgctggcgtaagtcttgattgattttcgtatacagcggcaacgggagctgtttcttcacttgatgcaaataagcctgccccttaggtgtaaagcccaagacgcgcaggtagttatgtgcctgtgcattctggatttctatctggttgagctgcaagagtgcggccgtcgccacccgctgcaatcgcgtatacgtgtagcgttttgacttgacctgatgaataaagtcatcaaaagtcgtggcgtgttgggccattgcctgcatccggtattccaagccctccgccatctgatcatactgcccactacgggcaacgtcgacggtcagcaattgatactgcaagaacggccaaaaatcgcgccagcgctgcagccgttgcgtggtcaacgccgtgaaggtatcagctgggacgactggtttcagcgccgcccaatcctgcgccagcgccgcttggcgaaccgctgtcccactggcatagcaactattggccgcaattgtcgtcgtcgcgtgatccgcttggcggcgtttgattggcaataactgcatcggatgtgccaaggcctgattggcagcgtaataacagaagctcagcatgtcattggccgccgtcaacgtcacgcccgtggcagcttgcagggccgcgttaaactgggtggcaaaagtcgcattataatgcgtaaagtcgccctgttgcgccgcaattgccgtggtcaaccgctgaaagtctaactcaggatgttccgcaccaaaaacaacactcgtgcagtccagtgcactgagcaactcaataccgccccgggcaaataaatgggctggttgggtcgcaaaaaatacgggcaattcgattactagatccgccccgttttccaaagccagctttgcacgtgtccacttgtctaagatggccggctccccgcgttgtagccaattaccgctcatcaccaccacgacacagtcggcattagtcagctgttgcgcttgttgcaagtggtagcgatgcccattatgcaacggattgtattcagttattaacccgactgcttgcatccttttcctcctgttacttacggcacttgaagaaccaccgcgttgtctgatcgtccggttgttggcggccaaagtctgcgctgactgtaacatggttgaaaccagctgcctgcaacgcttgttgataatcagccagcacgtaagtttgttcttgatgtaattcactgacttcgtcaaaggcctgcttctcatcattatagataaagaaggttagatcatgctcagcactgtgcggctgttcaccagcgtagctcgtccacataaaagcccggtcctcatcgcgataattatacatgtaccctggatagacctcatccgtttgataaggggtaatgacgtcgaataaaaattcgccatccgctgtcaaatgttgagccacttgttcaaatgcgtgttggaccgtggtaatatcgggcaaatagcagaacgaatcagcaaaacaggtaaccgcatcaaaggtcccaatctcagataaatcgagcatgtccccttgtaatagcggtaaggtcacggctgcctcgtccgcatgacgctgtgccagtgctaacatattctccgacagatctaagccggtgacctgatagccggcctgggctaacaacacccctaagcggcccgtcccacaagccaattcgagcaactgaccatcttggttaggatactcacgacggacaaaatccagccattgctggtacatggctggatcaaaaagttcgtcataaagttcggcaaacgtctgataaatcatgcgtttacccattgtgcaacgtccacgataggcgcatcagaccataatttttccaaattatagtgtgcccgcgcatccttttggaaaacgtgcacgatgacgtcaccggcatcgatcaagacccattcgccagcagtccgaccttcgacgctcttgacgtctgaaccagccttgcggacaaagtctacgatgttatcagcaatcgcttgaacttggcgcttggaatccgcagataaaatgacaaaatagtctgccatcaaactgacttccgctacgtctaaagctacgatatcatcggcacgcttatcgtcagcggcctcaacagttaattgtaaaagttctttgctatccataaaactctcccttaaatttaattggcaaattgagggtctaccccgccgacccacgcgttataagtcgctaacgtttgtgggtagactggcgcgcccttctgaatcagataatctagtgtatgttgaatttggaaacgaacaccgtcagccagcgacttggccgtcgcttcacgggccgcttcaacaccggggaagtcccgggcgggttcaataaaatcagccatgaagatgatttggtccaacttagtcatataaggcgctccgaccgtgtgtaaccgcaccgcattcaaaatcggttcattgtagatgtgcaattcatccttgatcagctcagcgccgacatagccgtgccagaccccatttccatatgagaccaggtcgggatccatgccacgcgtcttgatgagctgaataaaggtttgatcatcacgttgcttggcgtagtcgtgtaacaaccccgcaattccagctaactcgatatcaacaccgttgtcggcagctaactgccgcgccgtatcctcgacccgtaaacagtgttgatagcgtttgtcagtcaactgggcggcaacttttgccattagctcctcgtgacgatatgggacaattccttcagtatattcaatcgttttgctcatacaaatgatgctccttaatataagcggccacggcttctggaaccagataacggaccgaatgtccatggctgattttttgacgaatctgggtagaactaatatcgatcaacggtgcgtcgacccaaatgaccggatattgactcgtcgttggatacccggttcgtttgataccaacaaaggtgactaatttaactagctcgtcaatatgataccaagtatgcagataatcgaccatgtcgccgccaatgatgaaatagtactgggtgtccggatgcttagccttcaaaaacttcatcgtttcgtaagtatagcttttgccgccccgctcgatttccgccgtctccaaccgaaacagtggattatcaacaatggcttcttggaccatatttgcgcgatcctccaccgcaatcgtcttcttttcgtcgacatgcggtggttgagcgtccggcataaagcggacttcatccaaacctagttgatcaccaacttgctgggccatgatcaaatgtcccaaatgcggtgggttaaacgtgccacctaaaataccaacacggcgatgcggaattgccgtcaccgtttccgtcagaacttttgtcgctgtttgattaaccgtctgcacccgtcattcctcctataacttagcaacttccaatgaatagtgctggtcttcttcatgactagctggcaagtataagactagcacccggccaattgtttgaacgaccgtaatcgcggttttctgttcaattgcggctttaacttcagccgttgtcacatccgcgttttgtaaaatgttaactttaatcaattcccgcttatccagcgcacccgttaattgggtcaaccattcgtcagtcaagccgtttttcccgacagcaaatagtggccgcatgtggtgggcttcaccacgtaaatagtgtttttgttttccacgtaagttttccattaagtttgatttactcctataattttctgtttgataatcgcgcatcagattctactccgaccacaactctcaacgcttgttgatcatagctgggcgcgtcaagactgcaacaccctttggtgcccaggccgctacacgcgtatccgcagccaccgtgacccatccgagaccttcaaagacaatatcactgatttccgtcactttgaattcgtggcgaactagtggtggaaagtcagcgaccgcatcgccagttgggggggtgatcagttcacccacatgcttggtataaaagttgtccgcattctcagtccgggttcggtgcaaggtcaagttgttatcaacgtagaccgttccagtggcttttaacgtatcaacaatatctaaccgtgccaccccacctaagaacaaagtttgaccgttgcctaattggaaaccttttgggcgaatctcgcgttgtggtgagactaacttcaggtcatcgcctgacaacacgtgggccatctgttcgggatgaatgattccgggcgtgtcaaccatcatatggccatcatccaacggaatttcaatcttgtctaacgtggtccctgggaaccgggatgtcgtgatcaagtccttcaaaccggtattgttggcaataatccgattgatcaacgttgacttaccaacgttggtgacccctacgacataaacatcgcggccacgacgatatttttcaatcatcgccaagagctcatcaatggaatgccccttcttggcactcgttaacgcaacgtcaaccggtttgattccctgtgcacgaacttgttgattcatccattcccgcaatttcgtccggcgtaactgacgtggcaacacgtcttccttattaccgactaacaaaacgggattatccccaacaaagcgctggagaccaggaatgatgcttccattcaaatcaaaaatgtcgacaacgtacacaaccagtgcgttcgcatctcgaatcgtggctaacaaatgacgaaaatcatcatccgttaagccaaccggcacgatttcgttatagtgccgaagccgaaaacaacgttgacagtataaatcctgtgcgtcactagctaatgatttttgtaacgcacttttcggtgtgtagccggccgccttaggatcggtcgtttgaatcgccgcaccacatccaatacagtataaagtttcttctgatgtttcactcacttattaaggtcctcctgaaaatgcatttctggataaacatgtgctaatcgtaatttgataaaccgctcaaagaaacggttgatccgggtattccacgcatctgtcttcacgattggctgtactaagatactgggtacgcccgcaagatgggccgcccacatgtctgtgatatactgatcgccaaccatgaccacttcatttttgtgtaagcccaggtcatgccgtgccttactaatccccagcgggaggggcttcagtgaccgcgaaacaaatggcagttccaggctttgtagcgccttagcaattcgcgcttcagaattgttcgacaccaccactaacggaatgcccgcgtcctgtaacgcgtgcaaccactttttcagttccggggtgccatccggattgttccatgcgatcaatgtgttatcaaggtcggtgaataccgccttaatgccctgcgcccgtaactgcgccggtgttacattgtagattgctggtatcatccaagttggtttaaattgcttaatcatcgttatccccttcgcttctcgctggattttggggttattggcaaaaccccactagcccattttatcatactattggtgaaataccggactaaatcaggtctggagccggatttcactggacaagtgtactaaattttagtcatcattatataataatttgttttttgaaaattagcaacgaaaatccttccaagttgccttaatttggccagggtcaccgcgcccccacatttatttaatacgttgggtcccaattaagacgttgagagttatcagtaaacgctgcgacgtattgccatttgcgcttttctcgctagtttatccgaaaagctggcattcaattgatgcagcgaagactgtttgtcaaattagattaacaaagcgaccccttaagcgtatatttgaatcaggaatgcgtggctttaacttatatcatgataccgatatgcatattaattgcacgtcattacaatcctcgtgtaagcttatgattatggttaaacgtgccagttacctcaaaactgtccggcacagttggttcaaaccactagtgggtcgcttcacacccataaactgatgatatcagcaatgatataaactagtgacacgcacgactactaaatataacggaggttcgtttatggagaaaaaagatgttatgaaacaatacgttaccgataaatatttttcaaaggggcactggtggacgaagctttggcaaaccctagtcgcaattattacttggatctgcgtggccgtccccgtctactggactatttcgtcgacgttacttgccaataatccccagttcattcacgcctggaaatacgaagaaggtaagacgctgttctacttttttgaccggttcttcattattgcgttcatcttaatcgccattgtggtcattgtctccacgattcacaataatcaccgggtcaagcagcatatcagtaaagaacggcaatacaacgaagaccagttagatattcggaagcggcaactaaataacttttatacccaacgattcgggcaggccactttccggcaacacgtcaagcactacacagttgaccccgaacaaaatctcgatgttaatgaaatccacagattgtatgaggactagcccatggaaataatgcaaacacttaagcccttcgaaagtatctggaactttgttctattattattagtctcctacccgattctcggtgcgtttgcctggtttatcggcgttctctgctaccagctgatttaccgtcatcgccacaaagacgatattgaatttcaaccgctaacgcctgaagaacaaccctttatcacgatcatgattccagcgcataacgaagaagtcatgattgaacacacaatcaactatttaatgaacaatttaaattatgaaaaatatgaagtgctggtcacagacgatggttcgactgatgagaccccagctattttagaacgtctccagagcgtgtacgacaacctacgcgtagtaacaatcaagaaaaatcagggtaaggcccacgcgttcaacgtcggtgttggctttgctcttggtgaattcattttaagtaatgacgctgattccattccagaacccgatgcgctgtggaaatacatgagttatttcatgggcgaagaacacgccaatacggcagcggtcacggccaacatggatatccagaaccgaagcacgatcatcgccaagtcgcaaaccgtagaattttcaagtatcgttggtgttatcaagcggagccaagtcagtgctttaggcaacatgtatgcctatagtggcgccaatacaatgtaccggcgtgatgctctgattgacgttggcttattccggcaagaccgcgcgaccgaagatatcagtattgcttgggatcaccagttgaatggttggacgaccgttttctcgccagacattctattctatatgaacgtccccgagaatctagacgccctttatcatcaacgcaaacgttgggccaaaggtggtaccgaagtgctgttgaccaactttaaacgagttgccagtcatcccggcaagtatttgaagcaatgggcttttattactgatcaaacgctgagcatcatctggtccctattcttctttgtctcaacgctgatcttcctgatctcgctcatcaccttcttctttaccggcaattacgagcgcgtctatcatatgttctgcatggccttcatcttcgtgaccttcgagatgttcgctggtgtcttgcagctattgtccgcattgatcgttgacgaccgtggccgcaagttcaaatatctgattttcatgccactctatatgctgatctattggcaggttaacgccctcgccctggtcacaacgttggttccagccgttaaaaccatcctgggttacggcagcggcacctgggtcagtccagttcggaaacaccacattgaataactgagaacacaaagcgagccttcaatcgaaggctcgctcttttgttgtacgggtcactgctgcattcaagccaaggatcacaccccccgcatacacggggaacacccaagatatttcagttgccggaaagcaaggcgggggatcacccccgcatacacggggaacacttacttgggcggccactatttccagttggattaggatcacccccgcatacacggggaacacaaagacgtccacagaaacacctaagcacagaagggatcacccccgcatacacggggaacacagggttcacaagatggtttcaattcgtcttacaggatcacccccgcatacacggggaacaccgtccgattgattttatcgcgacagcactaacaggatcacccccgcatacacggggaacaccatataaaccaacatcataataacctttgtgaaggatcacccccgcatacacggggaacacttgttttggtatcagttcgaagatagaccgatgggatcacccccgcatacacggggaacactctaccggtgataagattacaaagggcgctgtaggatcacccccgcatacacggggaacacattttgcttcggcacgtaacatgtcttcgattgggatcacccccgcatacacggggaacacaacagtttcattagttgtaatctgaacaacttgggatcacccccgcatacacggggaacaccctgggaaggcaatactaatatttcagcctataggatcacccccgcatacacggggaacacccgtcttgagcaataatgtttggttgtgtattgggatcacccccgcatacacggggaacacacttgacagatcccgtccccaagcctttctgaaaataccaaacactaaaaataagttaacttgacttcgaggataacaagcacggacgaactgtaaaactaacccctgactaatacgctcgataaaaactagcgcatacctggttcgccagcactggttccgggcccgccaatccagtaaacaccgatgaaagtcaatcactgtacttcaggaatgactgtcattagccccataccaaatgccttttcacggccgattcctctcgtcaaggtttgcttgaaggtcggtaggtccttgacacataggagcccttcaaatgtcacacgacttaaacgaacgccgtgccctttagctcggtgaagcataggccaatcatgactcaccacgtcaaatgcgaattcgtgaatcttgtcagattccgtctcacgatgaccaaccagctcaaagccagccccgattgctcggtctgccagccattgcttttgttgttcaattgtcacgtgcggcactactcgccccttgggatgattgggctcaacaattgaatgggtgggattagcagtaagtcggaaacgcatcaccataccgactttgagctgatccaaccaggcatcataagatttggtgaccgctgtacccgcaacgccgtaccgttcgaattcttttggtgctggccgcgtggcactcaacaacaatagatagcttttgccgtttaaacgatcgatgcgccaaagatgacgctgccgttgaccactattaatctcatccggaaagctttgttccacccaattgtgataggcgcccaaatggctgagatcctttatcttacggcgattattggtatcaatttcaactcttgataaatacatcagcggctcccttctaaagatagttcataatatcgtgttcagtatcggcatccttggttgcgaaatacggattttcgagtgacacgcgatcaactgctaccgcgcggaatccatattgccgatgccgctggtcaaacgacacaaccatatccttcaccatcgaactaggatagtcaggcagcaacaccgcgtccgcgatgagttctgcaacgaaggtgtggtgctggatttgccgcatgtagaactgggatgcgtgccaactcgcggtttgtagcacttgcactggattacgccccgagcagactgccgtcatcatcggaccagccggaacgttcgcgcgtcgacctaatgcaagttgaaaatgggggtgccggatggcccagtcgatctggtcaataaagctatcatcctcactaccgagcgcaaccataaacacggcatcttgcaaataatcacgatacgtcaacttccgtcgattctgcttccattcaacaatttgaaaatcagtaagcggcttggcgggttgatcgattcgaacagcataggctagctggttcaacgtcttgattcgtgggtcgcgtcttgaataaccgagtgcggccgccaccataccgataatagcgctcttagaaggataatcataactggtccgccgatcaaagtttgcttcattaccgtatgattgtaatggggctgtcaatttaatcgttaccgtcttcatccttgaccacctctgttaatttcgcgacgagttgttctagtaagcctgtcaagctatcagcaggcgtcgcaacctctgactcgtcggcgcctagatcaacattcagtatcggctgctcaacaaatgacaacgctgcttgataggcagtcgccaattgttgcaccgattgcttgacgtaacccgtcttagaagataccggatcttcgaaaccagaaaccagattgactggcgtatcaggtcgcaaggtcaccatcacataattaggcaacgttttatttgcaaacgtattttgtttgccagttggcattgataagacaaaggctttcacaaattcacgaataccatcaatggcggcgggctcgccgaggttagcaattagctcattgatattgacattggcataccggtacaaagtcgctgagttaaattctaaggttcctaacatggccgccccagtactatcttctggctgcaaatcgtctaaggccgtaaaataatcaaattcaggcaccacttcatgcgttgagatagcatgcgcgacttgtgcagcggcgtcaacattcaattcaggattatctgcgaccattcggccaaacaatgctaaatcaatcgactgattacctttcaatacggctttgatcgcctttttatcaagttcttcatccgcattatccgtcacatactgtgccagttggtcaatttggccaggactaacgagtaatagcgcacttgtctcttcatccttatccagcttaacgctagctaacttgaaaacagcattaacttgtttccacgcatcatcgtcattcaattcaggcgttaacttctgtagcgcttgcttcaagagttgagccgctgctttagttctaaaacccaccgtcaccgtgtcatccttaaagttttggcgtaccgcccgcttccaactttgagatgagactcgtgctcgtgtcacacccccgtatagggccgttttgggtgccccagtatcatcccggttaatatttgaagatggcaccgtttgaatcacatgtatatccagatataagttattggtcgtcattagtttttcttcccttcagttgtcactgttagcggacgataatattgctgcccccattgcaatcgaacctggctcgcatgctcataatcttgctgaaaccagtaaaggtcttgcgctaaacgtggatagtcgattttttgcaattgatcgttggcttttagcatactgactaagtgtgtcagtgcgttgatgatactagcaacgttagtcgttgctagtaatggttgcatccgccggtctagcgcaaccctggtctcttcgttacgccgcagccttgcaagtgctcggaataacggcattccttgatcctttacatctgcatgcgggttcgcgggaccatacaccaaggattcagttccctgctgctggatcgcatagaatcgaatcgcggtataaacggccacttccgccttagtaggctggccatcttggctcaacatgtttggttctaaatgagccatcatcaccggccatagtgtctgggcttgcggactagtcagtgccgctgcgtgccggacactagctaacacacccttgttaagattaccattattgtataactgtcgaataatactgatagttgccgattgaattttactttccatctgcaattttcacctaccttccacttagttgtgtaaacacgagtcgacgaaattgatcattggccgtaaaaatattgacttgtcgaggcacgttatttttatcacgttcaacaatgccccgaacatcccttgatgaactagtcgccatcattacactggatgcttgtaatgttagttgttgcaaagtctgccgccattctttaatcttagcatcccgatcatcattaccagtcaagctagccagccagtccttaaatggtcgatttaggctcgcatagaactgagcactacggcgttgcgcaaattgtttagcgtcgatattacggatttggccgaccgttgcggcaaagtgatagtacccatccccaattctttgtgttaattcgatgacctcttcaatccgaacgggccaataatccgccgttgcctcatcgaacagcacatctgcttgaatttgcatatcatcatagacctcagttgccggcatctgtgacgacatgttgccgtcactgatcaacgccgtagaggccaaccacaattgccggtcatccgctactaagccctccgtcttcaagtaatgcagccacgcaacaattcccgcctcatgaatgtcgtcactacgattgacgttgacatattgaccaaaattacgccacatcgctttacccatatacttaattccattgactgccggccgaaaccgactagtctttttatcttgacgccacaaagtcatcggttcaatcagggcatcttcagtatcaaacatcggaatacccgcactatagattgtcggccgttggtgatcatcccactcaagatgcaataaccgtgaccaggtggtatacaatgctgctaagttatccgggacttgttgacgttgccgttcctgcaaataggcagtcaaagttgcatattcccagacgggttgctgtacgatgtactgttcatctgaaacggttgggactaagactaaattcaacattaaaatttcaaatagggagcgcccactcgcataaactggattgagtcgatacagccagccagctccgttagagaatttttcgtcactattaatctttgtcttgtcagtaaccccagtataattttggtacataatcagccagcgaactaactcggctaatgttaactcatttttagtttcatcaaccttgggagcgaacaacgctactgaattcccactctcagagatgcgtcgattcatttgacgtacagcaacttggccagttggtttgcccgtccgtttactacgcgcgacactcttagcctcagggacaaattcatcgtaggccgacgctgttacttgatagaatggttgatccccaaacaaatcgaactgccccgcatgacattgcaaataatccgtcacgattgtggaaaaatgaccacttgcaaacaagtctgcccaagtttgctttaaatcatcgtgaatctcatcaatcccatagtcctcatccacatgctcgacttcgaacatgtcgttcatagtcagccattcataggcttgattatcggcaccgtaacgcgtatagatcgtcgtcagaattgccaatagcagccgtaaaatcgctaagtcctgtgcacgcatatcgccagcgagttgtcgataatattgcgcattttgaaacagctcaattagtgacaccgtgaccgcttgattcgtacgggcatcgatcacaacaatccacggatccgtcgtcaagttaaaagtttgcattctcaccgtcttcattcctccttcgaataactcaatcctaattgtgatgagtagctgagccgccacttaccaaactcagcagtcagtttctgatccagtggtaataccaacaccccacgtagccaaatatcgtcctgccaacgcgcatggtaaggccgcgtcaaatcttctagttgattgattgctttagtaatgttaggcgttactgctaccggcaagcgtagcgtctgctgcgcaatttctgcaggggcgacttcgtctagtttacgaccatccatgagaaaatcagcttgattgatgtgctggatcaagataacctccaatgtttcttgaatatcacgcacagctgcactggcctgctgatcagtggcaatatctcgatgctcgcgattcagccacccatgaattgattgaccatgctttagttgcggctcacaaatttgaaaaacttgagctttttgttgctcagcctttaatttcgtcgaaaattcctccgcagcagccttaatcccaggaacttgtatatcagtcgccaagtcgtacacccgctgaacgagggtggaaatatcgtcaggtagcttaatctgattcttgagaaaataatcggtcttcatcaataaatacttgccgtagatggtctcattatcaccaccatagtcgccaaagcccttgatacccatgatgttcaactgtggttgttgaaacccacgtggccgtttaatcatttgatgtcgatgcaaacgaccagcccgctgtaagattaggtccatcggggcgatgtccgtatacaggacatcaaaatcaatatctaaggactgttccaacacctgtgtgccaatcacgactaatttcgcaggccgctcgccgtgttttccaatcgccgcttgtaattttatttcctgctgagcacgatccggtgctaaaaaggccgaatgtaacaccattaacggcatatctgcggggatcagtgctgctaagtcctgcgctcgcttgacagtattgacaataattccagcaataccaccctcacgcaattgcttcaacaacgtcataatcaattcctgatcatcctgattgttacgctgcacttcaagtgtaagtgcggcttgatcactttgaccttcaaaattagtcagttgtttgatgtccggaccgtccaatatgctcaacaacggatacgcctgcgtgtcttcccagccagtcggagcagctttcaatatttgatgatagcgacgaccatactttccccttatatacgcttttaatagctgatttcgttttattttgggtaaagttgctgataaaactacaacgggcacgtgatatgcgcctaaccattcgattgctctgagcagatacttattcatgtaggcatcataggcgtgcacttcatcaatcacaacaacttttccagagaatccaaggtggcgcaaaaaaagatgcttctgtttcaatcccatgagcagcaaattatcgattgttcccactgtaaatttggttaaaatcgactttttcccgccaaaccaactattgacagtcacggcaccatcatgttcatctgttgaattaacattgctagcattcggtagacgcttatacatctgattaaactgtgctttgccatgcatcaatttaattgagagtcgggcggactgctcatctgcaacacgctccagccagtcgttcacacgtgcaaacatcgcgttagtggttgcctgggtaggcagccccatatacacaccgtcacgaccggtcattcttgcaagctgttcaactgcaattaacgcaatctcagtcttgcctagtcccattggtgcctcaacaattgccattccaggatcagtggtcgcctcaagtgcgttcgtaatggctgcttgaactggtcgcgcatgaaaaccaaaacgcacctgatatgggtcccggttgcgatcaagcggtgccggcacccattcatcatctgactgccaagttgtgattgcatctcgaaaacgggcctgcaaattaatatctgtcgccgattgcattgttgtcactaatgggaatagtggtttgtccggattttcatttaagtactcgcttgaagccagccaatctgccataattaacaatccagttaaaatcacggcttcaggctgattcaaagtaggaatttcggcagtagtctgatagccggcggtatgtaacccatatgccactagttcacgttgaacttgttgccatgccatttgaagatcaggttggttatcattctgatagtaattggccgtatagtctttaatctgccgtttcggtgaagcgcttgcagttttgccatgatgcccaccaataattgctcccactgttgggttcacaccaaacgattctagaattgcttcaccggcaagtgcgtgaggtgattcacgtgcggaagacaagtttaaactagctaaatctcgaaatccattttgcatcagctgttcaatcaataattgatctaattgatgatcgccattataagcaggcttagtctgaaatgccggggtggcctttccaatatcgtgagtgaagcctaaaaacttcactaatctctgtatatcttcctccgaggttacctccgataattgttgccgctgtccctcactcagccagtggttgaataaccaattaatagtgttttcacaatcctttagatgcacaatcagcggcagccaaagccgctgaccatcatctgagcgtttcttagcccatagactctgtgctaaccgtgaaaattctgtcattaatcttctgccccctcacattagtattattagcacttttagacgataagtactggtagttatatacgaaaaataataattgtaccgtctaatctcagttcactaaaattactttcattggatatttacttatcttaagtttctgcggcctgtaaaacaattcaaaaattaactatatcttatactaacatttaaattctagaggttcagcttcggcttgataaaacgtcgctatctttgtctcaattatttatgtgagcaagaatcgttgaaacaataaataatctgcgctacggatgagatatgcctgctgcaagcctagtacttgggcccaccgcatagttattaatcataaatttatctcttagcattttgtatcacataatttatgcaacctaataatctcaatcaatactcacaacaagtacaaattctatacattgaaggccgccttgcttgtttcgtcatattaatagtgttcattaagcaagttgacttaaatctctcaagtactaatttgatattactgctataataggctttgtttagtctattccccgtgtatgcgggggtgatccaagaacggccccgcttttggattcgtttcaacatctattccccgtgtatgcgggggtgatcctgcttccgatgcgacagaaacatcatttctaacctattccccgtgtatgcgggggtgatcccaacccggttatttctctatccgcaaacgtcaactattccccgtgtatgcgggggtgatcccctgagggtatcagttctaatatgaaacttgaactattccccgtgtatgcgggggtgatcccaacttttcagtgttgcgtttgtagtaaatagcctattccccgtgtatgcgggggtgatcctgccccgatgattggcttgtctagattctcaaactattccccgtgtatgcgggggtgatcccaaacttgtcagacggataggcgaacaccccgtctattccccgtgtatgcgggggtgatcctacggtcaatcaatcgctattatccaccaattactattccccgtgtatgcgggggtgatcccacgatcgacacttctaagtatccgaatggtggctattccccgtgtatgtgggggtgctccttctaaacccgtcgatttcgactggtttaaaaactattccccgtgtatacgggggtaacccaaacaaagccatagataaagcaacaaatcactttgaaacaaatacgactttacagatatagacgtgcacactttacacatcagcacgctacaaagtctcactaaacgtttaaagaaccgtcgttaatcaacttatgtgttaactccagtgttgccttagcatctgaaagcgcgttatgtggccttaagttcacaatttgataatctgctaataccgttgacaggcgataattatccaagaagacatttgtgcgtttcacaatgggcatgagatctgttgtgtgattggtcagtccttctatgtcattttctataaatgcttgcttcaagaacatttcgtcaaaatggaaattatagcctacgattacactgttaccaataaaggccttcatttcactcaacgccatagctatcgaaacaccttgctcattaagcatgtcacgtgtaatcccagtaagttcaacaattttttgggacaacggtcgatcaatttttattagtcggttaaactcacttgtttgaccatcgggaatacttttaactgctgcgattgaaataatagcgtctttactcggatccaatcccgtcgtttcaatatctactgccacgaccgattcatcactgtggcgggactgttgccgctgaactttttgtgtcatcatccgtgccttgtggaacttggcagcattactataaccatgtttttccaccgtctgactcgctgcaaggtgcatcattaacggaataccatcaaaatccaccacttgatggtcatggcgggtcgtcttgaattgatagccaagttcgttattggcattgtagaccatggttgcttcaccccgaccaatattctcaacaattcgcaaccatagcgaatcacggacacgggcattaacattacccacgtagactcccgtctgaatctcttgataccatttagtcaggtcgccacgcaaggcattcggcacctttgttaaggtaactacaatcattctatgccacctacttcagtctcgtgatattgaacaccaaattcttgtaatcctaaccgatcgtcccaaaggctaagattgctaacttccgtagtagtctcactgacaccgagaattgccttcaagtctgagaccattcgtcgcaatagtttgccatcaacaaatgcgtcccgcattgccaagcgcgtacttctagcaatatcttcatcggccgtcgaagcagccacgatatcaaaggcaactggaattgaagtttcagccttatacaagtcagcgaaatcataaacaaaagataggtcatgaccagtatgtacaaatccaagccccgccgaagcccccatcgccataatgacgctataactcagcccatataatgcttggtgcgctgcagtcaacgcctgattaattggtgaactcgcttcaaaattgtcaggattgtattcacgccgtgtccagctgacccccgtacgttcagactccaaacggtaaacttgtcgaacacgtgcaccttccttaccacgcagtttttgcattgataaagttgtcacgtcatcattcggaaaacgcatttgatacatcttacgtgcaaccgccaatcgtgaacgttgatttgaaaataatcttgcctgggcttcaagcaatcgcgacgagtgattcaatgctcgaccatgtgcatactgccgcaccccacgctcaccgacccacacaactgccattcccgcatcccccattaattccattgcgcggtgcgtaacatccacacctggccccagcattaacacactaataattgctgcgggtacaaaaaccacgccacgagcatcactgactcgaatcgcactatcttggcgatcgagtttggcatgttccaagtataaaaatgttaatcgatcatgaattcgactcaactctgacaattctggcttttttgctccaaatttttccattgtttgtacacctccgacataagcaacaacaaattcgcaccatattcactaaccgacttagcaaatacgctcttatccttacacagcgcttgccccacttatatttctggaatagttgctaatcggacaactaataaagcgcttacaaaaccatgataaaaaaattccaacttcatactgaatatttacatctcactagagtcaagctattgcttaacaatacaagtatacccggtcaagaaatttttgtattgattccgaaaattattattaattaccttatttatattacaatgttttcattagaaatacaatatattttttcaagcaatgggaattcaatttaagcgcactaaactcaacagttcaaatagcgatcgactcgttttatatcagttatttacaattcaacccttatcgtacatgctatgagcaactcacattcaataaatagattttcaattatggttcttcccaatcacccaagtcggctttaaatatgttattctttagtatattaaatggctttataattacgcgtggtataaatcatgctaattacagttcctcgtctgtacgagggtgatcctataaataaggtcatttaacagtgttccccgtgtatgcgggggtgattaactgtgtgattgtgttgttgagtagttaactacctatttcctgtatatacgcggaggatcttatacaccacaatcgcccatactaaataatcgtcttcatcaatccatgacgacgattatttagtatgctataggattaatccccgttcggtttacctcccttttaacccttgatcgatggctgctaccgaagtatcattgttgttttagcggcctgtgcacattggactgttactctggccaattcgtgctgtgcgtcaataattcgttcagacccatacggcgcagtatcttgggccaccgacaattctgtgcagccaagaatagcagcatcacaattggcggcgttcaatagttggtcaattaatccatggaatttgacccgattgacatagtcatgctgcttgatatcttcataaatcaaagccattacttgagcttgctgctgctcagttggcacgaccggtatatgacccttagctagaatgagttgctgataaagttgtgacttcagcgttccagtcgtcgccaaaacaccgattcgtaacggtcgcgattgctgcaattgacaagccgcttccactgcaagtgccggcatattcaaaatcggcacgttggtaatcgctgttaacgccggcataaaataatgcgccgtgttacacgtcatcacgataaacttaacccctaaccgatcgagtaactgcacgtccgctttcaatgatggcagtgggttcgtacaattatgatccaaaatataggcagtacggtcaggaatctgcgcgtcgtttaacaccacataattcaaataatcttgatcacgatgcgtgacagtcagccgattaacggtatgcacaaaatcttcggttgccatcgttcccattccaccaatgattccaaaacaattttccataacagcacccccatttagcagacgaaagactaattgagacttacaaccccagcaataaccgatataacaaattgtatttagttaggttgttgcttattatctaacaagcgttcaactacaagcaactaatttgcaatccgtccccaacttagtacgttatcattgcttaccacttatttcgttattactcagcaaacacttttcaggctaaataaggggctattcacacatcaactaacgttaacagtttgccaaccactcagttagcaaaattagccgggctcacagttattagtagtgcttcacgacctgaaagcatcgcttggacgcagcagcacggtgcaaatttagtcgtcaatcatcgtcatgatttggttagtgaagtacatgctttaggtattaaagatgtcgattatatcctcggattaagcgatcttgacagtcactggaatgagatatgtacgctcgttaaacccgatggccacatcgcatcaattaccgaaaaccggcgcccaatcgatcttaaaaaactaaccaagaaacgcggaatatttgcttggaaatggatgtactcaaaatcctactaccacacggccgacatgattagtcagcacaatatcttagaaaccattgcgggtttgctttgaccgtggcttgcttcaaagcacgctatcacagacactacggccaatcaacgcgcttagattgtggcaggcccatcaacttatcgagcagcatcatatgattggcaaggtagttattgaaggatggaaatgagttggcgtgtattacggctcgcgcgataatgatcaactttaactcgccaaatacgctgtcctgttctgtcttttgatgcttacaactgatgttgcactccaatggagaaattattgatattcttggagccataccttatagtcaaagtagtggcgattttgcaagttaactaaaattccttgttttattatttttgattgttgatttaccgggatttatttagtctgttccccgtgtatacggggggtgatccaatttgaaaatcagtaagcggcttggcgggttctgttccccgtgtatacggggggtgatccggtattatcgctagcaaatcaaaaatattgtgctgttccccgtgtatacggggggtgatccaagaacgatgtttccttaattgctgggtcaacctgttccccgtgtatacggggggtgatcctcttccggaagtcaatatgaagcttgtgatggctgttccccgtgtatacggggggtgatccatcaccgcgaatcactgtcatgattttggcctctgttccccgtgtatacggggggtgatccgcgtgtcgctgtcgtccggtatatccgattttctgttccccgtgtatacggggggtgatcaaaggagtgagagaaacccactctcacattcaactgttccccgtgtatacggggggtgatcccttcttgatatccgtatcatcaactaccagcgctgttccccgtgtatacggggggtgatcctatccgctggcgatattcccggctggcatcgaactgttccccgtgtatacgggggtgatcccctttggcttgtcgctttccagcgtgtcaccgtctgttccccgtgtatacgggggtgatccctaaatcaacgctaaattctctttgagactcaactgttccccgtgtatacgggggtgatcccagaagcaactaagcaggctggtgaacacaaagctgttccccgtgtatacggggtgatcctcgtgccatcatctgcaacggttgccttggtgtctgttccccgtgtatacgggggtgatcctttggatatcaaccagcttgttagttcagcttactgttccccgtgtatacgggggtgatcctcaatgaccgaggtagagccagcgtttattttggctgttccccgtgtatacgggggtgatcccgtgtcattgtagataggtgcttctggctcaacctgttccccgtgtatacgggggtaatctaagtcattaaactttccagtccgaaccaacgtcaaacctatggtatcagactcgcttattttagcatcattccccgctaaaactaccaaactttctttttcagtttccaaaatattagtgctatgatgatagcatcaatttgactaaaacacttaatcagaaaggactttaaaattggcatttaaaacaccactggctgatcagatgcgcccgcaatcattggaacagatggtcgggcaacaggatctgttgaaggcaggccagccactacgccagattattgatcaacatgttaatattccactcattctgtgggggccgccgggaactggcaaaactagtttggcgcagattattgcgagtcaagacgattatccattcgtggcttttaatgcttcgaccgaaaataaggcacagctgacgaaagccatcgcacaatacccagagcaatcgtttgttctattaattgacgaaattcaccgaatgactaaaacattgcaggattttttgttgccctacttagagaatggacacgtgatgctaattggctcaacgaccgaaaatccgattatgtcaatcgttccggccattcgttcgcgctgtcaaatttttgagtttcaaccactgagcgatacagatatcgagattgctttatgccgtgcggtaaccgacatttacaacctaaccgacgatcaggtggacgctaaagctctcaacctgatcgctatttcggccgaaggggatctgcgaattgcattaaatatcttggaaacgctccacgccattgatcaaaagcaaatcaccgttgctgcggtacaacactttgcccagcaacaacattttagctacgaccggaaggcaactaagcattatgattatctgtcggcttattcggattcgatggctggctcagatactgacgcggcgctctactacttaaccattttgttaaaaaatgatgacttaccctcagtggtccgccggctacgtgaaattccatacacttatatcggcttagctaacccggaacaggtcacacaaattgtggtcgccgccaaccaagccgaaaagattggtatgcccaaagcaaagtatccactaatgtttgccaccatgctgatgtgcatttcacccaagtctggttcgtttgaccaatcttgggaaaaactagaccaggacacacaaaatcccagccagcaccccatgccccgtggattgcgcgatatgcactacaaacactccgaggaaattacaggtggtggtctgatcgataatccattccaaatgccacatcagattgcccaacaaaactacatgcctaaaggattggctggtcgtcgttattattaccctaaagataatgaaaatgaacgcaaactcggtgcacaatacctaaaactacatcgctttatttataacgaagattatcacgaatagataattactggcttattcaatcagaaatcacactcgattttcataaatcagagtcgcgcactaaatggctcacttaggccgttatccacgtatactccaagcggcatcaaaaaatggactcagtcaaatgaccaagtccatttttatttggcatcatcttttatgaatcagtgcacgccagagaccaagtcaattcgcgtcacactattatgccaaagttcttgggccgtataaacatccttttcgaacaacacgacagtgccatccggttcaatccgagcattggcacccaaccattcccaagatggcattaaccacaaattgcgccgcttccccttacccttttttggtgaccacgcagaaacatagtcatcaatgaaatgtgtacgcatgtatcgaaactccccattatcaaactcaatctgcaagatgttggcgcccatccagaccttaactgctttaggtaaaactgttgccatgatgacaccccttctccaaagctcccagccaaataattaatcaacatataagcaagcgcttacatcgttactatatcacaataatgtgtcaaatcaatctcaagattcagtaaggacgtcaacacaccgaaccatcttgtccaggaatcgtgttcccttaatcaagcgtatgacatgcccactaagactttctcgaacaactcatcatcgtcgtacttggccttcttagtattagtcttcatcattatttaaaaccccattcatgcgtcacgttcaaggcatcatcaacaaccccgtgattacgcacggacttctgcaactggcataacggtgatttcgagatcacgtgtcatttgtttctcaatcgcagtctgaacatcatgatccgttacaactaagctcgacaacttactctttccgttgataatatcttggacgtgttgattatccaaatcatcggcagaaacgattggtaagagatggaaattatcattcgttgcttgtaagcattggtcgaacaatggtgagttaacccccatgactaacacactgttttgttgttgtaagacggatgctaaccaccagttcaataattgtgcttcagaatggaagacattcgtgatggcttcttccttgttcactaattgaattgataattcgtggttgctaccgtattgcttgaccattgctaaagagtggtctggacgatagaagttttctagtgttacttgtgaattattcgtccggtcaaggtactgcgtcactgacaagaacccggcagcatcgtacacatcacgacgagttgctaatgacccattaaagtaagtcatataccagatggcaccgttcttacggtacttcaacgtcataattgggttaccgccatcgtcagcgatcgagacgatctgcttgtccgcattgcgtttatattgccatgctggattatcaggtaattctggcttggtcttcgcaacggcacccggtaccttagcctgaatcgtatagtacatgttgtacaaaccagtccgcttatcaactaaaccagctgattggtaactgttccaaatttcaggcaaactgtcgttgtagttaacggtaatgacgttcgccttatccttaacttcactcttcaataagcccatgatcatttccatcgaagccttttcatcaccagacaatgattgaatcaagtcggtactgaataaaaagtacttcgcagactggtcaaattcgacgggtgagactaagtgggtcgtcccgtaatccgattttaacttggcatcaatactttcaaccttttgttggagccccttaacgatcgtggcattttgatcatagtcatgctgtaaccgattaatcttctggttgatcaagttgagtgagcgttcttgttcgtcctgagcactcttcttcttgcgatcataagcaactaacgcatcttgagcggtatgtaagtctttttccgcactcgtaatcgcgtgttccttccgcgaacgttcacgggtttcagtctgttcacgtttctggagtttcacgagttcactgttgattgcgtcactcttttgatacaagtcctgagcttgtttctcctgctgcttcatcaacacgaataatttcttaagatcttgttcgccctgaattgctttacgcatattagcttcattttgcttcaaatcagctaatgattgttcggactgcgtaatcttcttttctaatgatttgatggtttgatcgctcttagcaagagctttcttggcatcgtcgtaacgtttttgagcggaattaatggttttgaccattccttgccgttcgccatcgttggtgttaacgactttatcctgcttagataaagtgactttagcatcctttaactgctgttccaaacttaattgttcagcgactaaagtctcatactgttgcttttcgtgcttacgatcctgaactaattggaccttaagctccccacgtaaagtttggtattgcttgtttaagtcagccatttcacgttcgatcgccgcactgttcttggctgccgtttgggtagcacgccgttggttgacccggttttggcccttaactggagcactagtcgaagccgttacgctactactagttggccggacaccagcagatgaccgcacattgggggtcgtactactttgagtcgcctttggttttggcttttgagcagcaacggttgaagtcgccgttgcacgctcagaatgattacggtaatcctcattcttatctctgcgctttttattgaacatcttcataatgcaactcctccataaacttgattgtttgctcaaagagtagaagggtcatcgcggacccttctatccgttcagcaaataatcaagctattctaattattatgcttcatgcttccgacgagaaacgccaaagtatagcgctgaacccatcaataaggttgaaagacccaagacagccaaagcagtcccgttttcgtcttcatccgtttgtggtaacgtctttgcgtctgaagtcgttgtcttagttgtgactactggcttcaatgaggctgatgcaggaacaaccccgctagtcccattgttagtagcagctgtcgtcgttggcgttacttcatcatcagaaaccgtggttgctggtgccgttgaagtcgtcgtcgatgaaccgttattgcttgacgaaccattaccattatcaacagtatcgtcacttggcgtcgtaacaggagcagtggtagttgtaccagtaccgccaccgttgatgttgtcacctgtaccaggtgcagtcgtaggtgcagttgtgatcgtaccaccaccgttgttaccattgtcgccagtgccaggtgcagtggtaggtgcagtcgttgagccgccattatcagtcttagcataagttaaggtgatcgtcgcgtcatcagccaccgtaccactcaaagcaccatcagctgacttgtaagtgtaaccatcgattgaaggtgttgcgaccgtgtaagtgtccccaactttgtaagttgtggtcgtcgcactcttgatcgtattaccatctgcgtcaacatagttaactgtgatcgtcttagtttgttcagttggagtagtgccaccgttcttcgtgtaaacaagggtaactgtattaccgttgtaggcaatcgttccggcaatggcatcaccagtggcatggtcataagtgtaaccagcaatttctggttgaccaaccgtgtaagcttgaccaacgatatattcagttacgctggatgctttgatggtgttaccatcagcgtcaacataattgatcgtcaagttagctttattttcaactggtgtcgttgaatccttggtgtaagttaaggtaatcgtcttattaccatcaaccgtaccagttaaggctgcatcagctgacttgtaagtgtaaccatcgatcgttggcgtttcaactttataagttgagccgttatccaaagtttgggtagtagcggccttgatcgtcttaccatcggcatcaacgtagtttaccgtgattgttgattgttcaactggggccgcattcttggtgtaagttaaagtaattgtcttattaccatcaaccgtaccagtcaaggcagcatcagctgacttgtaagtgtagccatcgatcgttggcgtttcaaccgtataagttgagccgttatccaaagtttgggtcgtagcagccttgatcgtgttaccatcagcatcaacgtagtttaccgtaaccgttgattgttcaactggggtggcattcttggtgtaagttaaggtaattgtcttattgccatcaaccgtaccagtcaaggcagcatcagctgacttgtaagtgtagccatcgatcgttggcgtttcaaccgtataagttgagccgttatccaaggtttgggtcgtagcagccttgatcgtgttaccagattcatcaacgtagtttacggtaacatcggattgttcaacaactggtgcataaatgaacgttactgtattagcaccagcaacaagcgtaccagcagcaacattgccggattgaacatcgtcgtcaccaatcttgtagccaacgtaggtatagccatcaagacttggagccgtcaacttgtaagtaccgccagcacgagtaaaggttttgtcagtaccttgagtatattggttagacttagctaatgttgtcccatcagcagtctgatagttagcaacaataccagtattttcggcgtagaccaatacaatttcatttttagtagcaaccgaatcgactgtaccagttaagccattgtcaccgggtttaacgttatcgcttgcgccataaagggcatagccatcaatcgttgcagggctaattgtaaaggtagttccaacctttccgctcttagttacaccgccggcaatctgagtatacttaggggtaccatctgcattaaaaccagtgattacaacgtatgccaccgaaacatcctgagcatcctcagctggtgtggtagtcgttacatcagtagttgtcttagcggtgtagtcccacccattctgatacaggctcgtatttccagacgcatcaatatgtgccttgtcatcagcatttggaatatcattgatggataaataatcactatttgaattagtgtcattagtagctgtatattcgtagttgaacgttagcgtggtcgcgttgatcacgtccttaactggaactacgatagtgctaccagtaccaacagtcactggggtgttctcatcgatttgatatgaaacagccttccaagttccgttagccgtttcagaactacctgcaggagcaattgagaattggccgtttgttcgacccgtattccagtcaatttttgggttcttggtaagcacgacctgcatgtcgtatttttgtcccttgacggtcttggcaaccgttgtgccgtcgactttcacgttgttggcgttaatatcatggctggcagctaatgacccattaccagtatcaaccgttgaagttgcttcagaagtcgaaccactagcagcttcagaagttgttaatgttgcttcactagtaaccttcggcgttgcgctagaggtcggtgcagtaactgttggtgtttcctgttgaacagtcgcggttgtatcaacacctgcagctcgtgactgaaccttagcagaagttgcaacagcagtttgcgttgtattattttgactagcaacagaacttgcagtacttgttgaagtagcactctgtgttgcagcagaagctgtagaagttgattgactagtcgaagatgcagaactggcatccgaagtagccgattgactagttgctgatgaactggcaccactagtaacctgttccgttttagttgcatttgctggtgttgtatcagcagatgcattgacattggcaaatactaagccggcagctaaggctaatgtggtcgcaccagcgtaaacccagcgtttgccatccttatacatctttacccgataaattgaatcaccggtcactttttgattatcttttgacatatggattcctccccaagcactcacgatttttggccttatgtaaaatgatgggcgacaaatcgcttgccagcccatcatcttagtcacgcgtctatcgtgttgtgcttattacaccataacggttttgttggcatttcagttttaaatgacgtattagcctttaatggctttgattacgttcaagataaaactgtgtaagccaccaaagatgtcatttgaaacacttgatgaatacgatgatgtgtgtgttcctggtaaaacatgaaaatcattgaagaagctcatgatctattccccttttaattggctagttaattagcctttaatagctgcaattacgttcaaaacgaattggtagaaagtacctaatggttggttacttacataactcgtgtgggttgcagtatgtgtacctggtaagaaatgcaaatcagaaaagaaactcataatatatatcctcctctattatctaaataatatcaagacattaattaatgaattaattaacctattatgttgaataaattaacccttgattgctttgatcaagtttaagataaagctgtggaagccgccaaagatgtcatttgaaacacttgatgaatatgatgaagtgtgtgtacctggtaatacgtgaaaatcgttaaagaaactcattgtaaaatcctcctaattgattaactgtaattatttgctgaacaagctcttgattgctggaatcaagtttaagataaagctgtgtaaaccaccaaagatgtcgtttgaaacacttgatgaatatgatgatgtgtgcgtacctggtaatacgtggaaatcgttaaagaaactcattgtaaaatcctcctaattgattaactataattatttgctgaacaaactcttgattgctggaatcaagtttaagatgaagctgtggaaaccaccaaagatgtcatttgaaacacttgatgaatatgatgatgtatgggtacctggtaatacgtggaaatcgttaaagaaactcattatataatcctcctataattgactgcgattatttgctgaacaaactcttgattgctggaatcaagtttaagataaagctgtggaagccaccaaagatgtcatttgaaacacttgatgaatatgatgatgtgtgcgtacctggtaatacgtggaaatcattaaagaaactcattgtaaaatcctcctaattgattaactgtaattatttgctgaacaaactcttgattgctggaatcaagttcaagatgaagctgtggaaaccaccaaagatgtcgtttgaaacacttgatgaatatgatgatgtatgggtacctggtaatacgtggaaatcgttaaagaaactcattgtaaaatcctcctataaattgactgtgattatttgctgaacaaactcttgattgctggaatcaagtttaagatgaagctgtggaaaccaccaaagatatcattcgaaacacttgatgaatatgatgatgtgtgggttcctggtaagaagtgcaaatcagtaaagaaactcatgaataactcctccttttaagttagttaatggttaaatccccaagcctagccaattaatggaaagacttgagagtttggaaaacaaattaaactccgacaaacttggttaaacggttagaaaattcaactaattaatcattggattccttagcacccgcttctagcgatgcctaacctttgattgcggcgatcacgttcaacacaaactgatagaaagtaccaagtggttggttgctgacataactagtatgtgatgacgtgtgggttcctggtaagaaatgtaaatcactgaagaaactcatgttaatatcctccttagaaaatttacaaattattcacaatttagcaactcaataatcattaatttaatttagtctgttaaataactaatattgactactaatgcgaatgtgaaacaagtaacctcgtttacgatttaaatattaacgaatccgccccaccatcgtcaataaaattactaatatttgaataaatacagggcagtatcatattcaatcagtaaatgtgcatactatggacaacttacgcgtttcattaacggtccaaatttaagtccaatatcaatattatttatgtttatcaccagttaactatgctcgtcgaaagcgtttaaacccctgataatatcagcatttcagcatggttgctacttgcgatattcccttcttttttctcgattgtgaaccataccatcgcgaaatttatcacctaaaaaataattataattttcacttttttgccttattataaaaattattaatactttttccttttatcacatcatttttatttcaccacttaaccatctctatccagttgaatacatatttttgtgcaaaaaaagcggctattgccaatactcagcaataaccacttactaattttaaacatcgaacattatttcactaaaatctttttaaccgtgttgatactgcaaccgataaaagtcacgataacgttcatgggtcgctagcaaggactcatgatcaccatcacccgtaatccgcccatcttccatgaagagaatccgcggatacgcctcgatctggttcaaccgatggacgatcgtaatcgtcgtcagatcagcaggtaatgtcgccaggagctgcgttacccgctcttggttctgattatcaagactagcggttgcttcgtcaagaatcaataaagatggttgccgaacaagtgcgcggacgatggccaaacgctgtcgctgcccaccagagacgttcaaaccgcgttcgccgacgtccgtatcgagaccggctgacagctcggctaaccagtccgccaagccgacttgcgttaacagcgcgcttaattgttcgtcaggcactgattccgtcgaaccaagcaggagattatcgcgaatcgtccccggcatcaagtccacttcctggctcacgtagccaatctgattacgaatcgagggaatcgtataactggccattgtctggccattcacgtccagctcaccgcgcgttggcgtatagtaagcctctaagagggagactaaggtcgttttaccgctaccactctcaccaatcaaggcgatccgctcaccgcgatgaatcgtcaaatcaatgtccttgagcaccggtttatcactttcgtagccaaaatcaacgtgatcaaagtcgaccgtattgattgttgacagcgtctcacctgacaaccgtttatcttcttccggactatctagaatgttgtcgatacgttccgtggccccgaccgtttgttgtaaggccgttactaagccagttacactactcagtggtgaaatcatttgaacagcgtacatcaagaaagccactaagctcccaatcgtcaacgcgttcgtttgtactaaaataccaccgtaaacaataataatgaaaattgccgccagtaacatgatgttcaacactggattaagcactgagatcagcttgatttgacggacactgaagcccttgatccgatcaacttggtcttttccttgctgtttcagggctttttcagcaaccattgccttcactaaccggttttgaccaatcatttgtaccgccgcactattcaagttggccgtttctttttgaatcgctttggagattcgcgctaacacttgacccattggcacgataatcacggccatcagtgggaccacaattaaaataataatcgtcaagcggaagtttaataacaacattaacgttaaggaacccacaattgagatgatcccattgatggcgttcgaaaactgacttgaaatcaattcaaaaatcgttgatgtatcgttgaccacccgactggagagttcccccgtgcggttatggtcaaaataaggaatcggcaagtccacaatatgttgccataacgcgctccgcaacgtcgaaacggcgtcgacccccgtataactgagtagaaagcttgacgcgacactggcaaataactgtacgacaatcacagcccctaaccgcagcagcagttgccccgacgtgccatgattaaaagcgtcgataaattctttcaacatcagcgtaatacccagactacaaatcgtcgcgacaaacgacaacagaattccaaccacaaagagtcccttcttggggtgggcgtgggtcatgatcaatcgcagtagatcacgggtcccatacttggcatgtggttgtttagccgatgacgtgatatgcgtttccattggttgtaactcccctcattgcttgaatatcaggctgaatgacatgatcattccaccgttgccaaatcatcgcctcagaaaagcgactactattgccgtacgcccgctcactcatcttcgccagctgcttaggatgttgtaggagcgctaaaatcaccttgcccaattcaactaagttattcggggtaatcagtcggccattttcaccgtccttaatcatcgtggccggtccatacttaatatcataggcaactaccggaacgccatgacttaacccttctaaaatgcctaagttaaagccctcatattgactagtgaggaccatcagttgtgcctggttataaaccggcgctaaatcgcgctcaaaacctttaaaggtgatgaaggactgccaacgttgcgaactgaccaaggcccgcaaccgattttcttctttaaatccagtccatgaatcaccataaccataaatatctaaggtcacattcgactgtttttcatgaacataggcgactgccttgatcaattgttccagatttttctctgctgacaagcgagccacggcaatcactttgccgtcagttcggtccttaaaatcaaccggacgagctgctaactgttcatcactaacgctgccgacaggaatcgctaaggttggaatcacattatgaatgtggttcgtcatatcatcacactcttcttgcgtggacatgatcagcccggccatttgactggcatggtctaatccgatttgggtgtacggcacgatgggcgagttcaccacgtccagtggatccagcgtgaaattactgtgtaagaattcatacttgcgtgcagcggtgctcatcttcacaatcggattcatcccagcatcactacgatccacgatcatcgttccgtgaccaccatactcagtatttaacgcgtctaagaaaaaggcggtcaactggtcccagtcctcaaattcgtaattatggccgtgatagttcaacagccgttgatgagtagcaactggttgctgcttctcattaggccggaagaacgtctctaagacgggttgttgctgcagattgcagtgttgttccaacacgatattctgctggtcatcaaagtactgggccaccgttaagaagccccgggtatcgtaatagtcgcggcgactaaccgcgccctgcggattgagaatatcaacgtaatcaatattgccctgcgcatttaacatcagtgctttctggcgttgttcccgttgaatgacgtcaaattcattggcactgacccgctctaaggtttcaccggtcacccgcggataattagccgccgttaatggctcaccttcataattcgtggtgccttgaaaataatcatacatattgacttgaaactcatcatcatacccaatgagctgcatattatgatgtaaatcgcgtacaaagttccgggtcacgatcaacgcaggtacccggtgcttcgtgaatagtttttgacgctgaatcatggctaactcaatagctgatggcgtcgaatcaattttgctcgtaataaagaaatacatttgctacgccccgcttttattcatgtgataaactttcgactggatctagccgcgccgccatatgtgccggtgccaaagcggccaataaactgatgacaacactgactgtgatgccacctaacatcgctgctcccgagattcgaacgattggatacttaattaagttatagatggccatattgcctaaaaattgccaaccttctccaaacagtaaccccataacggcggctaataccccgatagttaaggcctcagcaaagaacaaatgactaatatcgcgtttgcgggcgccaagtgcgcgcaaaaccccaatttcacgagtccgttcagaaacactcacgtatagcacgacgataatcatgattgctgaaaccaacaatgcaataccagccaccccggtcaatacgttagtcgctaaacgaatatacgtattcaatgaatcaattaaatcaccgattccagtatagttatactgttgcttcttatcggcccccttaattgtcttgatcttatgttcgacctgcttaacattcgccaatttatcaatctggacaatggcgaagtttggtcggtaagcgacgttcttagcggttaacatctttttgacagtttttggcaagacaacgacgctggtatcatcgctacccgtaatcccactgacggtaagtgtctgcttgatcgttaccgcctgatttttgcgattaaccgttgccaatttgacagtcaacttcttgttaagtgcctttcggtagtttttcttgcccatcatctttttggctaacttgcgaccaatcaagacttggttagttccaggacgcgagccattcttgatggtcttgctcaaaattgtcggattatccgtctggaggctagccgttaccatggtttttttgtaactcgcttgggtgctcgtgtaatatcccaacttagtggacttaacgtgcttgattgccgctaattgcttcgcgttagtcgtcgtcacttcggcatttttcgcggctgtaacttgctcttgattgaccgctgccttgtaagccgccgcactcgttgccttcttacgcgcaaccgtgctgacctttcccgtcttttttgacacctggacagcggtcgggttgacttgtgacgtaatctgatgattcatgtaattttgaatcccagaccctaaacctagcatcaccacgatgctactgatccctatcgaggatccaaaaatgatcagtaggtaccggagccacatccgccgcatatgttgcatcgacatccgaaacatttgccgaaagccaagtgtccggtaacgcgttggctccttatcgaccacgtcgaaaggtgccccaatcactaattcgtcatgaatctgaccgtcatccaaatgaacgatccgtgtcccgtagtcggccacttcctgcgagtgagtgacggtaatgacaagcttcccttctgcagcgatcgaatataaaatatccatgacttcctgggtattttcactatccaatgccccggtcggctcgtcagcgataataatatcgggatcactggcaagtgcgcgagcgatggcgacccgttgcttctgaccaccagataactcatttggatactggtgcgtctgctgctcaagccccacccgtttaagtagttcctgagcttcctggacctgtttggcatgggacgttttagtcatcttcaatgaaagcatgacgttatccaagacagttaggtaacttaccaagttaaagttctgaaagataaagccgatcgtttcgcgccggtaccggtccatttgccgcacattcatcgaacgcaaagattggccgtccaacaagacatccccatcataatgatgatctaagcccccgataatattcattaacgttgacttaccgccaccagactccccaagaattgaaataaactcgccccgttcgaagtttagattgatgccttttaagatgacattttcttggtgatttaaggtataggccttacgaatatcgtgtaattctaaaaagctcatatatgtacctccactattttattaactacattccccacaatgtatttcctcattaataacattgcgttttttggtgaatgatgtaaagtgttattgaatacctggggtcatcattcacaattaaaattataatcatcttaaaccccatcaatccgcatacttggtaggtacaatttgtaaaatatcgctcattttgcacttatttttattaaaaattttctgtttcgttattattctatgacggcaattaatacttaactgtcggtataattcaacccaagcaccccacacattcaaggtgtaaactaaaaagtcctcatcactagacacgggccctagtgacggggacttcatgatattaaattaaagccgctcactcgaattgtactcgaaatgaggtttacttaaaaaaggaccgtttggtgactacccggtaaatcgcatctgccagcccggtcacgaaaacaacgatcagcccggcgaattgcaaccatggcaactgttgtttaattactgccacttcactccccagccagaaaaccagtaagccaaggacaataatgatactttcgataatgtttagtttacgcatctcagactcctcaagaacatcacacattgttgcgcgcaaccaccatgcgtgacgatatttatacttccctatccaatttattataacccgtccgcgactaaatcgcatcacaaccagtcctatcacacttaccaactcggccctacgcttattgcgttgtctagcaggcataaagtgcgttggacgacccgcgccgaagaactcatatgtgatgttaagttagcgttcaggttaatttcggcaacaccagcgttggccccaatattcagattgtcagtgccacctcagggcagctacagagaccgagtaacaaggatactcaaaaaagccccagaaacaagcaacctatcatgatacagtcacgaacctgaccatcactaaaagctgtttatttgaggggcttccgtactacgttattagcctgctgataccttagtcactaaggcgcgcagttaacttcttagttaattcttcgtaaccaggcttgccaagtaaggcgaacatgttgttcttgtaagcttcaacaccaggttggttgaatgggttgatcccgttcaagtaaccagaaatggcaactgcagcttcaaagaagtacatcgtgtagcctaacgtgtaagcatcttgtgaaggaatgttaacgaccatgttaggaacaccgccatcaacgtgggccataataaccccttcaaaggctttggtgttaacttgagccatcgtcttgccttcaagatacttcaaaccatcaaggttttcggtttccttaggaatgtcaacgtcactagtagcgttgtcaaccttaacgaccgtttccatcaagttacgacgaccttcttggatatattgacccaatgaatgtaagtcagtcgtaaagttagctgatgatgggtagattcccttttggtctttcccttcggattcacccattaattgcttccaccattctgagaacatcgccatgtttggttcgtagttttcaagaatttcagtggtatagcccttccggtacaagatgttccggtaagcagcgtattggtatgcttcgttcttagttaaatcggcatctttgtattcactttgggcatccgcagcacccttcattaatgaatcgatgtccccgccagatacagcaattggtaataaaccaactggtgtcaagacagtgaaacgaccaccaacatcatcaggaataacaaaagtttcgtagccttcagcgtcagcttcttgcttcaacgcaccgcgcttacggtcagttgtcgcataaatccggcccttagcagcttcttcaccgtacttcgcaatcaaacgttccttgaagacccggaatgcgattgaaggttcagtcgtcgtcccagacttcgaaatgatgttgacagagaagtcccggtcaccgattaagtgaattaagtcgttgacgtatgaagatgagattgagttcccagcaaagacaacttgtgggaatttacggtcttcacgtgaaagtgatgaccagaaagtttcgtgtaagaattcaatggctgcccgtgcaccgaggtatgaaccaccaatcccgattacaacgaggacgtctgaatcgtcttgaatcttctttgcagcggttttaatccgtgcaaattcttccttatcgtaatctgttggtaaatttaaccagccgcggaaatcattaccggcgccggttccttcacgcagctccttatcagcagctgtgaccatagcttgcatttcgccaagttcgttatcatggacgaacttagttaaattagagctgtcaaatgaaatgtgtgccatttactattacctctttctatacgtatttacatgtcatattatacaatagctcgcctaataatgaaaagcgcttccccctttttttcgtaaattttcgtaatttgtgtaaaaaataaatacaattattaacaaaaaaggtgctgataacttaccgttaccgcaccttcagcagatttttacaatctgtaaatcaaataattaattttttagtaaagctttactaagccttcatcaaggacaacgcgaccccaccaacaatgacgaggatcgagccaatcacaacgtagaccatttcccgtttcgtcttgtgctcacccaagaggtaaatgctaccgaacgtggaaataacgatccccatttgtgacagtgagtatgcaacggcttgtccgatttgggccattgccataaacatgaacaggttcccaacaccccagaccaaaccggtcacgatgttacgataagttgctttcacgacccatggcttatccttaaaggaccagatcaaagcaccgagtaacatcccaacggcttgcggcattacgactgcttgcgcgttaacgttaccatagtgaacaacgatcgtatagcccgcatagccaatcgttgataggatcaacgcacgaatcccaacgccccagttttcagaagtgctccggttcgggtcagtcttatcagtcaaggaagtcaatacggcccccgcaatcaagacaatgacggaaatcgaaccgacccaatacatgttaccgtgccattcattgaataacagcacaccggccaacgcgttcgcaactagttgcatcccggttgagattggcgtggtccgtgaaataccgaccgccttcattgatgtaaattgttgaccttgaccaatactccagaatagccctgagacgatcccaatcaaccaaattttgcttgttaaagttggttgttcaaccgcccagagtgccaaaccaaataccaaggcccccatggtcatcccaagggtctgttgccgagcggtaccgcccattcggccactaattaagccgatactgccccacgcaatcgcaggaatcagtgcaattagaattcccattactaataatcctcatttctatgttttctctcttgcctaacgacaaagaattattttaccagttaagtaaccgttttaccagtcacaatcagggattcagggctaaatataattatttttatattttcatgaattcgttttcttagtgatagggaccgttttcaattaatgaaaacggtccccgaaatacccattaaaatttttttctgctccactcaaattatggcgcaataactacttatcgagtgtcaaaaccaagaccttcaaatagttgcttgccaagtaggccttgcgcgtcacaaagtcagctggtaatcggaacgtctcactgagcgtgaagtgccggtcacttccaacgaaagccgccgtgaccgccgctttaaacttcttcattgagaaattattcgcggtcgtcgcgattactaattgaccgtcacgccgaacgactggtaaggtcgccgtcaataaatcagttaagtcagttgccacttggaacttttgcttcttgacccgtgcaaaagtcggtgccgtaaccacaacaacgtcataacttagtcggtgcttctgagcatagtctaaataactatttacttcgattgcccgaatttcttgcttatcagggtcgatattattgacggctagttgatcagcggtctccttagcacccttcttgcttgtttcaatggagattgtcttggcagcccccgcaacggcagccgccgccgtaacaccattttcctggctaaataagttcaaaaccgtcttgccttgcaattcggctccggccagccattctcggattggtcgcatatctaatagcaacccggtcgtcaaatcatcagccaagtgtaacgggtacgttaccgcaccttcagtcactaataacggctctggtgccgcttcacccgtcaccagttggctcttcaagttagcttcttcgacgttgaaccgtaatttggcataaatgcctttaaattgatgttcagtcgccgcttcaaacgccgcatagagcatctcacgttgctgataaacaccctgtgcgtaccacgtgaagacatagtaatcttgataccggtcgatggctaagccgccaagaccgtcaccatccgcattgaagacccgttgtggtaattgtggatccatgctagttgcacgccgaaccagcgcttgtttgaataacttacggaaataatcggtcgtcggcgtctcgctttcatccaagctcagcacccaaccgagttgccggcgatgctttgcaatcagtgcgtaacccataaattgggagcttgccattaacgccacaaatgagccatcggttagtttcatacttggatccttgagatcatcctgtacgagtaagggatagccatccttgactttacgttgagaatttcccgtaatttgtactctttgcataattgttgtttctcctattcatttcaaatcttatctaaactattgataaatcgctgtttgcagccttgttaagggtaacatatttagcctcagagtgcgaggtagaacagtgtcaatcgctgaaaagtattaggcttaaggtccgcaatcgattactattaaacgtccgttcctactattaatgatgagttattgctatggccaccgttaccccgcattagcaaaaccgggcctcgagatcattacgatccccaagcccggtccgtacggatttacccgctttaaactatcacgttaatcatcaataatcggtttatcaaaaccttcatctgggaaagtaacggtaaaacacgtcccttcattctccacactgtcaaccttgattgaaccaccatgttgttggactaattgatgtgaaatcgctagccctaaacctgattcaccgtacttcgtattcttccgcgatgggtcagctttgtaataccgttcccaaatattcttgacctgatccggcgtcatcccgattccatggtctcgaatcgccacaaccgtcgcatgatcggtacggctacccgttacttcgatcacgttggcttgtgaaaactgaatggcgttttgcatgatgttaaacaggacctggacgaagcgatcataatcagcccatactggcagtttttcaggaactgtcagcttgaattcatcatccgcggcggccgctttctttgtgagctgttcaactaagttatgcaaaacctcggcgccatcaaaattggtcttgttcaaagcaatctggccggtccgaatcttttcataatccaagttctcgttgactagccgaatcaaccgcttggtctcattttgcatcaactcgatcgaatgacccttgtcttcttctggaatggcgtcatacgccaatccttccaaaataccgttgatcgtggtcaaaggcgtccgcatctcgtgcgctgcatcagccataaactcacggcgccgcttctcctgccgcttgatctcatcattagaagtccgcagcgagttgaccatgccattgaaatcatccgccaagtcatcaatctcatccttatgattactgtcaacttgaatgtcgaaatcaccatttgcgactgaatgtgttgcgtaccttaaacgattgatgcgtcgaacggagtaacgcgccagaatgtaactcaatagtagcgccgcaatccccgagactaacagtgcaatgaacagatttttttcgatctgctgttcgttagcctgcaaggtctgttcaaacgacccgattgagatcgcaccgacgaacttcttcgtggccccattcttatagaagagcggcactaggacgtcaatggttcgcaatgacggcgtgttcactggttgatcgcgattgcgcgttctaaacgtcacgtgcggcgactgcgtaataatcttattccgcttgagcttcttccaatccttggctgagatcttaggatcatagatcgaaccaccgggggtcccactcatcgttgatcctacgccactcggataaactagctttttgttggcatcatacactgaaaaatgaatgtgttggtcccgtaagatgaccgtcccatcatttaaaaactgttggttgaacccaacgacctgattagtcttcgtattataccgaatagcttccttttcaatactcgcggcatactgctgcaactgctgccacgagttttgatagagcatcgttctagtcgttcgaatgaatgagaacccaagaacgacgattaccgtaataatgacggcaaagaatgctaacatttgttgatagatcagtttcattgagcgtcaactccactatcatcaaatttgtagccgaccccccaaaccgtctgaataatttgtggcccagctttttcaatcttttggcgcaattttttgatatgtgcatccacagtacgttcgtcaccataatattcatagtcccagaccagttgcaaaagttgttcgcgtgagaaaacttgccgcggcttttgagctaaggtcttcaataaatcaaattctttgggggtcaagtcttgaatttgtttgtctgctaaataggcttcccgcgtcttggtattcagtttaaaatggtccgtctgaacatcaaaggaactcaccgtgctggcaggttggtcagccggcgtggtcttggccaaatctgctcggcgatgaagggccttgatccgagcaatcagtgtaatcggcgaaaacggcttggtaacatagtcatctgcacccatctctaagccgagtacctgatcgctttccgaatcacgggccgtcaacataataattggtacagttggggaagccttgcgaatatccgcactaacttgcatgccatccttacctggcaagttcaagtcgagtgtcaccatatcccagccatcgacatcttcattgaacatttcgacagcttcattgccatcataagcaaagtgggcatcccacttctccttcttaaaaaacatggccatcatttcagagaccgatttattatcttcaatcattaataatttcataatgcaacgtcctccaagttaattacgattgctaactttattgataaatcatcatttattaacctatctattatcataccctacttcgcgctaggattcaggattagtataacaacaaattaataacaaagcgtgcacgatttgtgaaataactgtgtcatcccatcattgagggacacttaacactcttggcacatcagtcgcccataataccacagtcatgctcactggcataaaaagcacgattttctgccgtttataccgaccaggaaatcgtgcatcattcagttacatttcacgtgttacgagcgttaagtcatcatttaaattcaggatgactgccggtctaccccttcacaacgttcactgtgactaattcttaaaggagtggattggtgccggaatatgacccccacgcttaatgaacgtcgttggttgattggtgttgaccggcataactggtgcttgaccgaacaagcccccaaattcaaccgcatcaccaacacctttgccggtagctggtatgacgcgcaccgccgttgttttgttgttgatcatcccaatcgcagcttcatcggcaatcatcccactgatagtcgcggcactagtatcaccaggtactgcaatcatatccagaccaactgaacacactgctgtcatcgcttcaagtttttcaatattcaaacgaccagcactgaccgcccgaatcatctcagcatcttcagaaaccggaataaaggcacccgacagtccaccgacatgttcgcaggccatcacgccacccttcttcacggcatcattcagtaaggccaacgccgccgttgttcccggcgcaccgacactttccaacccgatttcttccaggatctcagcaaccgaatcgccttcgttaggcgttggtgccagtgatagatcaacaatcccaaatgggacgtgcaaccgttctgacgcgatggacccaacaaattgccccatccgtgtcactttaaacgccgtcttcttaatttgttccgacacaatgtcgatcgactgaccgcgaacttcttctaaggctcgttttacgacaccagggccactgatcccaacgttaataactcgatcagcttcaccaacaccgtgaaaagcgcccgccatgaacggattatcgtcgaccgcattggcaaataccactaaactcatgcaattgaccggatcgtcagccgcaatctgctttataatacgacccatttcaccgaccgcgtccaagttgattccagcccgtgtcgacccgacatttaccgaactacaaacacggctagttgcagctaacgcggcgggaatcgatgcaatcagtttgcggtccccactctgataccccttctgaaccagggcggagaaaccaccaatgagatcgacacctagcgcttgagctgcccgttccatggttactgcgtacgcgacatagtcttgatcctgactcgcagccgcaatcaatgcaatcggcgttaccgcaattcgcttattgatgataggaataccgtactcttcttgaatttgagcggccactttgaccaggtccttcgcgctagtcgtgatcttatcatagattttttgccgggcccgctcaccatcactatcaacacaatcaaagagcgaaatgcccattgtgattgtacgaatatcaagattttcctcggccaccatctgaattgtttctaaaattgaacgactttccatggccgcctcctataacttctgaattgcgtcaaaaaccgcttgccgttgaattcgaatcgttaactctgatgcctcaccgagcgattctaacgccgctttggccgccgcaaaacttaattgctggtcatcccattccgccgatagcatcatggtaaaattatgatccatcaaggtttgcgaaatatcgacaatattgatttttaaacgtgctaactcgttcgctacttttgcgacaattcccacttggtcctgtcccacaacggtaataattgctttcatctttatagcctccgttagacgcatcattattcgcgtttgattgttcatatcatagcatgagttcttctgaaacgcacccgttacttttgatgaagtaacccatgagaataataagagattcctcataaacataggttcccagacgcacctttgctataatgaaaattgcttattattttcagaaaggagtcgtaatttgacacaacaaaatcatttacggggcgtcttactcgctagtagtgcctgtattctgtggggtatctcaggggtggctgcgagtaccctcttcatcaataatccgcatctaaccgcaatgtggctaacgcaggtccgcatgatcagtgcaggcttgattttactcgtctgggggatggtggctggtaaacacccctttaaaatctggcatcaccgccatgccgcttggacagcggtgagttacggtttgctggggctgattccggttcaactttgctatttcgaagcggttcgcgttggtaatgccccgattgccacgattattcaatttcttggcccattcattatcagcatctattacttcttatttaagcacgtgacacccagtcgtatcgaactgattggtatgatcatggcctttatcgggacactattgatcgtgacacacggtcacttaaacagtctggcaatttcacccgtcatcttgttctggggcggcttatccgccatcggggtcgccacgaacaccttgattccgcgaaccattttaccaaagtatggcgcattaaccgtcactggctgggggttactgattgcgggtctgtttctaaccttgttacaacccatgtggcgtgtccacctgacgattacctggccccaattaggcttgttaatcgtcattattctcttaggaacggtggcccccttcctgatgtttgcgcgtagtttaagcgatattctaccgacaacggccagtttgatggacgccttcgagcccttagccgcgacggttttctcgattacttttctaaacgttcaactcactagcttcgattttatcggcggcttactgattatcttggcagtcatggcactttcactgaacacacataaaatgttgcactttttgcggcgccgccgagcacactcttcatcttaaactgctgtaatgattgtcatgaccagtagacagattagttggcagaacagttgagctgtgctaaactaggattgttgaatttggggatgttctggattcgacaggtatagtttgagttcggattgcgcttcgtaggttgcgtctacgtaaaaacgctcagtttaaattataactgcaaaaaataataacaattcttacgctttagctgcctaataagcgcttaacgtagatcctcccaggatcgtccatgttctggatctgggtcctaaatttagtggacttacgctcaaagcttccacctggagttgcgagaagagactaatcaggttagtcattgctgggtgccctgtcatacggcgtttgcaatgatgaaatttaaatagtatgaatatgagcgtagatatccgaggggcaatatgcttggacgcgagttcgactcattaatacactaccttaattataggccaaaaagcgtggtgtggcgcactgaatgtttggttttagcgagaaatcattgtggattagtttctcgatgatttatacggattgcgacgtaaagggcacgggtggatagataacaaattgcaatgacaattaccgcaatctgggcaagttattgcgtgatatatgtatttcacttgttttaaaatataaaatatataaagtgcgtctcattaagaattgtataatgatgggtgtagtcaatcttttcatgatataatagccttgtttacattcagggtgtgtacattaatttaaaaaaattaacgaaggaattttaggaggagttttactatgaagcgagttattacgtacggaacttttgatttattacattatgggcatattgagttactcaagcgtgccaaatcactaggggattacctaattgtggccctatcaaccgatgagttcaactgggacagcaagcaaaaaaaggcctatttctcatacgaaaagcgcaaggcattactagaagcaattcgctatgttgacttagtgattcctgaaaagtcgtgggatcaaaaagtgagtgacgtgaaattataccaaattgatcgctttgtaatgggtgatgactggactggtaaatttgattttgtgggtgaacaaactgacgctgaagtcatctatttaccacggactcctgaaatctcaacgactaagattaagcaagacttgaatttcaatcaaaaataaacgtgtgacggggaattcaataaaatggcattaaaagatattatcagtcaggtttatcgccgactgttcaatgtaattgcgactgtgtgcccagtgagaaaacacgttgttttgtttgaggcgtttaatggtaaagttccaatggataatccgttatacgtttacgaagcacttcagaccgcgcatccagattggaaactagtctggggtgttaagcgtcagttggttgcggaagcccaggaaaagtatcctaagttgaatattattccacgcttttcagccaaatggttattagtggcaccggttgcagaattctgggtcctgaacgcgcggatgccgtattggttgaagaagaatgcgaaaacgacctatattcagacttggcatggtacgccgctcaaacgtctggggattgatattccaaaagtttcaatgcctggtaccgatacaagtcagtatcgtcagaatttcacgacggagagtaaacggtgggattatttaattgcacccaatcagttttcaaaagacgtttttcgacgagcgtttgattttaacaaccagttcttggattatgggtatccccgcaacgatcggttagtgcatcagcgccaggattatgatgcgattgcagcgattaaaaaaagaattgttggcaataaaatgggcaaagtaattttatatgcgccgacttggcgagatgacttttttatccgcaaaggtatgtataaaatgaacttgccttttagtttggccgctattgttaaaaggcttaataaggaagatgtgcttattattcggccacattacctagtagctgagtcgatcaatatccaaggctttgaggacaatgttaaattatgtgtggatgaagatattaatgatttgtacttaattagtgatttattgattacggattattcttcggtcatgtttgattacgctatcttgaatcgacctatgctattttatccttatgacttagcgcattatcagggtgatgttcgcggattctactttgattacaacaaggttcctggtccaattgtcaccaatgagcaggattttctggccaagttagatcagttcttgattaatgatggttatccaaacgaaaaagccaagatgatggcatttcggacacagttcacggaatgggagcaaggaacggctagtcaacgagttgtgaagttgattactagcatagatcagaacgcaaataattatacaggctaatccattagggctagagtactgtagtcaagtacaaggagtaatgatatatattatgggaaagatgaataccatcaaactcgcgtgtaagtttgttgcacggccaattcgggagtttgtaactaagccggcaattcgtcaaattaatgtttatttatactatgtgaaacatagcaaagttcaagaaaaggctgttttcttggaatcgtatcatgctgtcaatttgactggaaatgtgtatgcgatgtatcaaaagatggtacaagaatatccggattatacgtactattgggcatacaaagacaaagatacaattcctgcggatattatggcggataccaagagacatcgggtatatttagttaagtacgaatcacgtcagtatatgaaagccttagctacctcaaagtatttaattaacgatacttccttcatgccctattttattaaaagggatgggcaacggtatctgaatacttggcacgggacacctttaaaaacactgggattagatattaaaggttcaggtagggcagaccataagaatattcagcgtaatttattggcggctgatgtcttagctatgcctaacaagtttacggctgagcatttaattacgagccatgatttaaacggtatttttccaaatgaagtctatattactggtaatccacgagttgataacttactagggacactagtttcagaggatacgcaagcgttgaaagagcgcttggggcttccagctgaaaagataatcttgtatgcgccaacttggaaaaaagatgtggaatatactactgaagctgatattttacagttgttaaatgaagtccaacgattgcaggaacgtgttccatctggctacaaagtatttttaaaagtacattattttatttatgataaattagttaaaatgggatatggtgatcaattgatttcaaatgccattgataccaacacattgttacgtggtgtggatgtattgattacggattattccagtatctttttcgactttttgccgattaaacggcccgttatgttttatgttcctgataaggacagctacgcacagaaccgaggcttttacaagccgcttgatacacttccgggactggtcacggataagtttgatcaattgcttaatgactgtaatcaaaaatactttgattcgtgggccaagacttacgaacaacagtacaatgattatcaaaccgaattcttgagttatgatgacggacaagcgactgaacgtgcagtgcaagtattgtttgaagagtcgtcatcggttgagcaacttaatttcaacaataataaaaagaagttattgatttatgccggaggtttctataataacgggattacaaattctattattaatttgtctagaaattttgacactaataaatatgaattagtgtttgttgattatccgcggatgcgccctgaaaaagaatataatatgagtcgtttacccggcagcgtacactttatttttagtttttcatgggcaactagaacattctttgatacttataatcagaacactagctaccacttcggatttaattcaaagttagttaaccaaaataagatgaaggcaacgtatcagctgaattttaggcgtatctttggtaattttatgccatacgaagctattgactttggtggctacaacaaagctattactggattatttgctttatcaccagttccaaagaaggttgtctttctacacaatactatgtgggatgaatataataaaattgttaatgggcgatacaagcatcgtaagaatctgcgtgttacgtttacttattatcaatattttgacaaaatcatttcagtttcccaatcagctgataaacaaaatcgagaagatctgagtcagtatgctgattctgctaagtttacatgggttgagaatctagttaatggcgccgaaattgaaaaagaattatctgaggtaaagcaacaagtggataatggtgattcactgatagagcttactaaaacagagacaccaagcggaattattacaactcaattattccatcctgtagatcagaattattttaattttgtgacggtggcaagactgtctcctgaaaagaatcatttaggattaatccaagcatttaagttagtacatgataattatccgaagacgcgattatatattgtcggggatggtccaatacgactggaagtagagcaacttatttccggtttaggattagatgaatcagtgttcatgatgggatttttgcagaatccaatgaaatttgtgtcatttactgattatgttgtactgccatcagttacagaggggcaagggcttgctattattgaagctttgcttgcacacaagccggttgttggaacagatgttgctggtattcaagatgtaatcaagggtggacgttttggcttgctgagcggtaaaaatgccgtagcaaatccaaatagtttggcgaatactttagctctctcaattgagaccaaggacagtatcaagtatgtaaaaactgtaaaagaaccattgaaaatctttcatgctgaaactcaagttgacggtcaatggattactagctcagatgactggaaaaatccagatattattttaggaaatgataacaatgggcgtgcattcgttgaaattaaacacgttgaaagctatccgaattacgcggtgtttattgatggaaagcgtgccgctcagaacagtcaacttgctcattatgatgtacaaagtgatgtagcaataatggttgtgctagatatggaacaacaggtttgttttgaacgctttgattggcgtgattataaccgtaatgctttaaatgaatttgaaactagggcaattctttgagattctacttgtttattaattttatgagtgtgatttacgttatagcgcatagaaagagactcgaaccttctcattttgaggcagtcgtgagcctcttttttgaaaataattacaagtaacattcagcaagatatagtatcaatattgcgtcttagtttaacttgttcccaataaaagtatttcagcccgctgattctattgaatttaaccgggtgtattctttacaaagaaactattaatgtaactttcgacttagttacactagtttggatatattaatcatattagctaaggaagggctacgcatgtttctcaaaatgaaaaatagtcgttacttcgaagcaaccttaacattaataattatttctctattggctctcatttcgacttatccagcctttagtggacatttctttgaactcagtaatgacggtggtgttcatctggcccgcctggaatcattatatcaagcatttaatgccggacgggctccgagcctcatcaacttcatcggctttaacaatcaaggggttgcgatgaatgcgatgtatccctggataactttgttaatctatataatacctcggctcattattgataaccccatgcttgcactagctgttggtttctggttgatgaatttttttacaatccttaattcatactggctagcaaaatcattgactcgtaatcggttaatcattttgttaagtgtctctatctatcaatttagtgcttatcatcttcagctaatgtatactcgtgtggcacttggggaagcgctcggctatacatttctacctttgattatgttgggattgtttcagatttggaatcgaaaaaaacaaggcacaatagtccttgcaataggtatgggtctagttgccaattcccacatcctttcattagtgctatttacagtcttaattagttttcttgaaattattaggttactttgtcgaaatctatcttggcatgagttgcttcagttactaatcggcgcttttatcagtataattatgtcaagttattccctatataatattgttgactggctattacacaataagatggtagcacctgctcgactgcttattagtctggaccctttaacgagtttgaatcgcatgttaactaataacattggagagttagctagaggggctcatttaggtattatagtgacctttatttttctctacttaatttcacagctaatttcaaatcaaacaggttcatggcgctattggatcattggtgccgcaagtatttgggtgttatcacagaactggattgatggtgattttttagctaacaccccagtaagtttatttcaatttacaatgcgttttctaaccattgtcgtgttattactcatgattggttctatcttgttcttagtccaaattaactggcactcatactcaacgactctttttatcagttttgctttaatcacagttggcatgagtggcgtaatatctgctcataatcaaactaaacaaaattatttctgggcactgaaacaatcgaagtccaattcacttgcacaacaacgtcgaaatcaatatttaactaatgctaactaccaaaagcgattagtcgatacacaagtgcctgattaccatattaaaaaggctgagtctgttcagtctttgaagaaagtgagtgctgcgcttaattttgccacagcatcacgtgcaaccaaaaaaactgtgcaatttgatgctaataattctcaaaagttcaaaaacacatttgcaaatgatcaactagtaacttttaaatatcatcagaagaatatgaaatcagttaagttacctgttattggctataaaaatgtaaattattcggttaaggtcaatggtaaaaagaagaactttaaatattctgagggacaattaaaaacagctttaccggccggggactcttatattgatgtctctatagctcgtcagtccaaacacattggattgttattgctaacgggcattacgttcattggtagtctggtttatctagcaactaactgttttaaaccaaaatacaattaaaacgattccaaggaaaacttgattttctttcgaaaaattgacttaactagtaaataattggagtgtatttatgtattaataatgtatttgtttgattttagttcacccattagttggcttttaacatttaaactgatggatatattctttgtagttaatatgatgaaacaattggttcgtcgcggaatgaatagccaattcatcgtcaagttaagtaggcaagctgtattacgtctgactcgtaatcagccctctttattagtggctaatattctatttaagaatattagccagtcaaaactcgatttgtttcaaccgatagtgcaggttaatataaggatgaagacttaattggatcacatgttattaatctgtagaaacggggcgatgttgtcatgaaacgaattgttgtgggaatcacgggagcgtccggtacgatttacgcggtcgacttattagaaaagttacatcagcggccagatgttgaagttcacctggtaatgagtgcgtgggctaaaaaaaacttagagttagagactgattactcgctcgcgcagttgacggcgctcgcggatgctacttatcgggctaatgaccaaggcgcagcgattgccagcggttcgtttttaaatgacggaatggtcattgtcccagctagtatgaagacggtagcggggattgcgtacggcttcggtgataatttaatatcgcgggctgctgatgtcacgattaaagaacaacgtaaacttgtgattgttccacgtgaaacaccgttaagcatgattcatttagaaaatctaacgaagttggcaaaactcggtgcccaaattattccaccgattcccgctttttataatcatccgcaatccattcaggatctggtcaatcatcaaaccatgaaaattttagatgcgtttcatattcataatgaaactgatcgccgttgggagggggattaagtatggcaacttttacgactgagcaggccgggtatcaaatgcaagcaacactccaagtgattggatatgacttgttgatcgtcgttaccggtgggaccaatccccatattggtgacgtgaccacactaactgccagcacggttcccgaaacggttaagtttcccagccatgatggtcgcttccataaagataactttatttcggaacgaatggccaagcggattcagcgttatctagctggaagctgtacaattactgcgggaattcatgtcaaccaaattactaaagcacaaatagcagctgcggcaccaatgacggatgacctcagccgccagattattagctggttacaggcccatcccgtccaggctgaaaagccagaatattatggacaagatgagcaaccgcggtagattcgtgacgcatggggtgtcgaaaacagcgcaatattgtcttttcgccctattgctggataatatgcaccgagctggccgtttattgttattaaagttgtactagatgaaataattcaacaaaaaaattgcgcttcagatgttgattctgaagtgcaattttttgtctaagttaggcataaacatactagcatgtttgtatttaaacggagtggcttgcagggtgaattataactttagtatcgacatgcgcgctggcttccacaatcgcacaccgtcagctaatctggcagcttatttgtgggcatctttctttgcttgttccactaaaatgttatcgaccacgtcttgtaagctagtcttagctaaccgtgcttcggccgccgtttgcgcgtcttgatagtattgtttcagaacggtttgaatattgccaccaacaatacaatccggattggtcttaggatcgacggcgagtagcggcttatcgccctcaattgcgtagaagacgctgagcagtgaaatttgacttaaaggtttggcgagtgccggttgagcagtaccgggcgttgtcgtaattagtccggcttgtcgaagcttgctcatcaatcggcgaacaacgactggactagtttcaatgctgcgggcaatggcgtcacttgttaatttagtatctgcgtaaattttaatgtaggccagtaaatggatcgagtcgctaaagcgggttgaaacacgcatataatcacttcctgtaacttaattggttactatgattataaataaatccacttataaaagcaattaacgagtttagtaaagctaatgatgtaacttttataaagatggttgttttgggggaccgaatcagttatgatgtaaatgccaaaattgagcagttactgcaaaaaaggagcttatcatcatgagtgaaattgaaaccatccaggcctattatgcggcttcattggggaaggatggtcgtattacccggacccaacggcaaattttagccgccgcgctcgacttatttgcagaaaaaggttatgaagaagttggcactcgggagattgcagagcgggccggtgtcgctgaaggaactttatttcataattttgttaataagaacggtattctggacgtcattatgcagccgattgtgcagaatattttgccaacgatgttgaacactttggaccaagcagttttagatagtcctaaccagactttgcaagcatttgttgtcgcccttgtgcgcgatcgggtcgcatttgtcacacgtaaccgagcctccttagccgtcattttgtcccaatttttcaataatgctcaggatcgagcggccgtcttagggatggtctcacctagcattttggcgcaggcgaatgaagcgatggatcgcttgaaagccgctcgagaattagttgattggccgaatcgcatgattttacaattggtgttttcaaccattgggggatatttagtcgaacaggttctctacccacaattggatgatttgagtgatgagcaattgattcactatctcagtgattttttagttaatggtttgagcccacggagaatccccttacaagatgataataccgcgtcgtaacaagctttagggatgccaaagtaataattaataatagttgactaataggttaatggtgctatactaccaattggaattaaagtgagtgctcaattaaggggacgcactgttgaggatcacgtagtagtccacaacctgaattctaaaccaatagaagagagggtttcataatgaaatcagcaaaaacgaaggatcacgctaagatgaaagctgccgaagaaaaggcgattcattcaacgggtgccgatagtaagagcttggacgaagtcaatgggagtgtccgggtccctaaggatgccagcttctggcgaactttaattgcctacactggaccgggtgcactagttgcagttgggtacatggatcctgggaactggattacatcaatcgcaggtggatcacagtacaaatatgcattactttctgtgatcctgttatcaagtttaattgccatgttgctacaagccatggccgctcgtctgggaattgtgacgggtaaagatttagcacaattgacgcgggaacgaacgtcaaaaggaatggggatttttctctggattattactgaactagcgattatggcgaccgatgttgctgaaatcattggttctgggattgctttgaagttattattcggatttccattaattgtcggtattttgattaccactgccgatgtcttgattctgttattattaatgaaacttggtttccggaaaatcgaagcaattgtggcaacgctggttgccgtgattctcttcgtcttcctgtatgaagttattatttcacaacctaatattccagaaatgttaaaagggtatgtcccaactagtcggattgtcagcaaccgttctatgctattcttagcactcggaattgttggggcaaccgttatgccgcataacttgtacttgggatcatcaatctcacaaacacgtcaagttgaccggagtgacgaaaaagaagttgccaaggctgttaagttcacgacaatcgactccaatattcaattgtcagtcgcgttcgttgttaatagtttgctattaattcttggcgccgcactgttctttggaactaagggggatcttggccggttcgttgacttgtacaatgcacttggcgatagtaaggtcgttggctcgattgcgagtccgttactcagtatgctctttgccattgcgctgttgtcttctggtcaaagttctacgattacggggacgttatctggtcagattatcatggaagggtttatccgtttgaagatgccactctgggcacaacggttactaactcggttaatctcggttacaccagtgttggcttttgcgatttattatcatggcaatgaagcgaaaattgaagatctgctgacgatgtcgcaagtcttcctgagtatcgcgttaccatttgccatgattccgctagtcatgttcacgagtaatcgggcgctgatggggaacttcaccaaccgtgtctgggttaagtggacggcttggatcgtgacggtgattctaatcatcttaaacatttaccttattttacagactatcggtctggttaaataatcaaacattaaaatgagctttccagggattgcaaagaattcctggaaagctcattttgtgttttgggaacagctgcaatgcaagataccaattcaaagcgccaagtgctaatacgtaccagtaattggcgcttaaccgactttggatggccagtcttgcttagttggtatgatggtaaacggggtcgcagtgatgagatccgtgaggcaggggagcaatccggtctcaaggttatataaatcgtgaacgtgtgcgctagtttgaccgtgctcagccatcttaagtagttgaggctgggtgaactggagttgactggctggtagaatcaggtccggttggctgcggcgtgtcaacggttgggcgtggtcgtgaaccaggtaagcaaaattaggcgccgtactgagaattagcgttaaaacgctgatttcatggggatctaatttggttgctaactggttcgtttgactaggggaataaaccatggcggcgtagatttgaggcgccagctcgggtaattggcggctaggcggtgtcagggtgaccgtcagtcccaattgccagctggcgagcaacaatcccggaatcgttacgacttgtgcggggctcagtagaatggcttgtccggcatgcacgttctgttgttgcagactagtttcacacagtgcgaggtcttctaaaacatcggccccggtataccagttgccatttaaatctttcagaactggttcggcatattgacgttgtaattggcgggtaatggccttagtcagctgactcatcgcggggcctcctttaagggtttaagtgacggggcgggaattgagggtggcaggactactttgcgttagtgagatacttcatcttagtgatactttggctactagcatcaatggttgctaacacttgattttgggtggatttaacggctagcttagtcggctgcggtgttaaatcgtgtttcgactggtgggtcgtagtacccgttgcgagtttagtatcacgagtaaccttgttgacgagtgtggtggaggtcacttcaggatttgttgtcgtcgtgtcagcagaggcggaaacggaagttgcaaagagggttccggcagccattaaagtaagggttagttttttgaatgtgtttttcataataatcgaactccttttagttgttattattagtgaatgattattgggcagctggcattaaccagtcgttagagagtagttgatggaagtgacgaccaagtgggacccataattgcgaacggcggatgttttttaacgtgtcccagaataatggatcttgtagttgttcatcactaagtttgactttaacgaattcgccctcttcagttttcgcaatcaccagtgggtaggtcaccttaaccaattgaacggcggtgatatttttaatttttggatcagtatctaataacatatctacatagctccttagttgttgtgagtcattctgtttttatgagttaatttttaaagttggtttgtttaattgaatgactatagtttaccggcatatcgccgtgggaactatcgactttccataaactttatctaagaaattcttagattcagacttagatactgataaatagggtgatgacaagtgttgaattgccttaaaaaagccagttttaggtgcatgaggcgacctaaaactagcttggtagtactattttgaaattggccagctgaccgtaaagacactcccggatggctggttgtcggtaattttaatggtggcctgattcaatgtaactaactgttgaacgattgctaagcctaagccactgccttcgattgcttgtgaccgagattggtcaacgcggtaaaaacgctgaaagacagcctgtttttggtcgtctggaattccctcaccatggtcggctacagctagttcgactgcttgatcagtctggtgcaaactcaaggtaatcggttgatcatgtggcgagtatttatgggcattatcgagtaaggccacaacgatttgttgtaacatttccgcattaccttgaacgtggatgttcggatcaattgcgagcgtcaatggttgatcaattgatggctggtaatgttcagccagtgacaacattaatagtgataggtcttggtcagttaagactagcttagcgcgatcagctcgtgaaaggtgaagtaggttctcaatcagatgttgcattcttagtgattcttcatcaataaactgtaatgattctggaatcacttcggggtgggcgtcaccccgccgcttgattagactgagattaccgcgaatcgcagcaatcggggttcgcagttcgtgtgaagcatcagaaataaattgacgctcatgctgcaatcgttgattttgcgtgaccaatagttcattaaaggcccgaccgaggtcgttgatctcgcgggggctagcaggcacgtctaaggtgggctggtcgctatctggattgttcgatgtgtacttggttgcgtgtaacagtttaatggttgggtcactcagtcgcagtgctaaacgatgggcccaccaagtccccaatgccagggcggcacaagtgacagccagcatgagcagaatcaaaataagcagactgttgaacaatcgccttaagctgacccatagttggtaagtgttatgcccatctttttcactataagataagaagaaaccaaatccgcgaacgtagactaacggccctactagcttagtctgttgcttggtgaaaaacgatttggacgatggggtagtgatgatcgtccgcttcgttttagtggcggtcgtcaaggttgctttcttggtggttacccggataaatgccggttgtttcgtattgcgtgtcgtcgtattgttccattgaataaaactggggacgtctttgatattcgcctggttaagactgctcatcaagtcacgggcttccctagtcgtattgatcgtttgctgagtgccgaccatcagaagggtgatcaagctaaccaacaacgtaattgtcagcattagtcggcggatggccttattgatcagctgttcataggtcggagtggtgttatttttgggcatcagacatcggctcccttagtttatacccgacgccgcgcactgtttgaatgagtggggaggcgccggttgtcgtgattttattacgtaaataaccgacataaacgtcaacgacattttgctgaccgagaaagtcggcgccccagacctggtcaagcaagtcatcacgggtaaagacttcgtcgggatgagcgaggaagaattgcagcaaatcatattcacggtgagttaaggtaacttcttcctgcccgttagtaacgcggtgggctttggtatctagctggatatcatccagttggtagacttgattgggttcaacttgattttcaatgcgtcgttggataacccggattcgggccaataattcttcgatttcaaatggtttggtgatatagtcgtcggcaccattatctaacccggcgactttatcaccgacataatctctagcggtcataataatgactggtacttgatcgtgtttgcgaatgcggcgaagaacttccataccgtcaagttttggcaacatccagtctagcaggatgaggagcaactcgttttgatgcgcttggtaggtttccatagctgccaaaccgttagccgctaccaaaacgttgaaatcctcaaattgtagttctttagtcaagtagccagatagactgccttcatcctcaacaattaaaatcgtgtttttcaatgttatgctcctctcaataaccctggtttatgtctaattatagcgaataattatgacgcttttccgatattttgacttatttttatggatctgtgtgaactaaatgaaagcgtcaccggacttatgctaaaattggactatgaaaatggaaggtaagtgagtgacatgggactttttcgtgacgccatgcaggcactgtatcacagtggtcattatggttacaacatcaatgtaaagaagtcggctcccgccgttgatccgaaggaagtaccagcgattgcggcgttaggacgtattaatcgaacgcccaactttaagacgtggtccgttgattcgccatataaaacggccgaatttacggctaaattaactgacgcagtagcaacttgtgatttggaaatgcaggatcttgagatcaaaccgcagatcgatggtcggtggggcgatcaataagcggaatttgttcctataaattctaatggtcatattaatttaatgatagaccaattaatcaatagtgacggggtgagtcaatgttttcgtacgatcaggtccaacagttaaaccgcttggaaattgaaatttataagtatattgtgggtcatcccgctgaagtaagtactatgacgattcgacaattggccgaccatagtcacgtctcagcaacgactattttgcgttttctaaagcacatgggctatgatggctacgcagaatttaagttcacattaaaagaacagttacggcaagatgccacacaaccgttagctcagacagttgtaccgatgcggacgttttttgaccgcatgaacttacctgatatcacggctaaacttcatcgggtcgcagaactggttcatcaagctcgaatggtcgtactgattgggtcagggacgagtgctggcctggccgcgtatggcagccatttattcgctaactttggtttatatagcttgatgattagtgatacgagtcagccccatccggttcagcaacaggatttatcggataccgtctttttcgcactttcagtatctggagagtctgaagatattattgaacaaagcgtttattatcggcagagtggcgcgaaggtggtcgctattaccgctagcagtcattcgacgttagctgggattgcggacgtggtgttaacttacgataccccggaagttcaagcaatcagtggtggtagcaccttgtcccagttgcccgtcgtttattatctggaacaattagctatgattattcagccattaacgtaaaggtaattcaaaccaatctttggaacatgttctaaaaatagaacaaattccgatggatggaacaacacccattttagagtgaaagggtatacattttgagaatgacaggtataatgaattttgtaggaagcgcattcatgggtacaaatgtcagatgacaggactactttgtaacggactaactcaattttatgtaaacggttaactattgattgaccgttagcttacttaaattattctgattgtttgagaatgttcgttaaatgaatatgcacaacaaattattttagggggtcacgacatgagcgaaaacaataacaagtcgagctttgttaatgaccgacttgtccctttctttggcaagattgctggttctcgtcacttaattgccttacgtgatgggatgacattggcagtgccaatgattattatcgggtcggtcttcatgatcattgcgcaattccctatcaagggttatcagacctttatggccaatacctttggttcgaattgggcaacaatcgtccaatatccaactaacgcctcgttccatatcatgggcttgattgcggttattgggatttcttataacttggcaaagagttataaagtcgatccaatctctgcctcaattgtttcgttaggcgcttggttcttaacgattccattaaacaccgataaggcaggagcactgtgggtaccattaacccaacttgattcggcggggttattcacggcgctactgattgggttgtttattactgatttttacgttttcatggtgcatcgcaattggacgattaagatgcctgatagcgtgccaccggcagttagcaactcgtttgcagccttagtacccggtttcgtcatcttattcttgatgtggttactgcggttggctgttgaagcatcaccaatgcagagtattcctaacgtgatttcattcgtcttagctaaaccattaggcttgttgagtaacacgttaccaggggccttggttgctgaattcgttgtatgtattctttggattttcgggattcacggtgccaacgtggtttctggggtcatgcaaccaatctggttagctgcgatgtctcaaaacgcggaagcgcttaaggctggtaaggctttaccaaacgttgtgacgcaacaattcttcgacaactttgtccacatgggcggttccggtgcgaccttgggattggcatttatgattgcctttgtctcaaagagtgctgagttcaagacattaggtaagctggttatcggacctgcattgttcaatatcaatgaaccaattgtcttcgggctaccaatcgttatgaactatcggattgccgtaccatttatcttggcaccgctagttaacgttacgacgacttacattgcaatgtcgacgggcttagttgcgaagacggttggggtcatggttccttggaccacgccgccaattatctctggttacttagcaacgatgcacatctcaggtgcggtattacaaattgttaatattgtgatcgatggtgccatctactacttcttcttcaaggccttggatcgtgataaggttaaggaagaaaagacctttgctgctaaagaagctgctggcgaaacggtcgaagcttaagttaaatcattaatgtagtaatcgtataaataccaccattagcgatttgttgaaagtcggttgatggtggtattttaatgtcgacttttgagaagcaagtgcgaattaaagcgaaccaagtgacttagaattgtcgccgggttcgcctttttttaacgggtatgaaattgtgggtgtaacatccggggatgaccatggtcagtacccttgtactgcaatagccaataagcgttttgcggtaaagcgctacgggcaatgacgtgtgcaacggtgtagcgaatcgtgtcggcattagcgtcagtccataagcgccaagttggtagcttagctgcttgaaccggttcccaatcgcccaatgcttgctcactagtagttagcgcggtgagtaaatcaggccgttcggaaccagtcagttcaatgtagtagcaatacgcttgcggatgcagggtgttgggctggctcatgatgagattgctcctttggatggttttaacgagttatcgttgacttaaataaccttatcatcaatcatagtacaaccgtttgactaatttgactagttttttcgcttactgttattaaaatgtaatattcaaactttcaattaaaaatatttgagtgtccccccttgacctggaacgcgtttcagcacgtatattaagtggtgaaaataacgagggggtgcggcacgaatggaaacgggaattttaaaacagattgatttaacaacgacgacggaacggtatttcttcgtgcaagtacaacgactggcagactatgtctggattcgctcagttcaaaactttaagccgttagagttaacggttcgggtgagtgatttacaggtgaacaagcaccaggccgttgctgaccgggggaatatcaaatatgagtttaacgacgataccgggggactggtgacgcaacttgctggctgggtgcactaagacggtgacagacaagcagtaactgtgatactttaggcaatcaacaaccaataatactaatggcagcaatcaattttaactaggctaggactaaatcaggcgcgccactgaaggctataatgcttcagtggcacgcctgattatcattaaaagatcacttggtattatcactgtaagtgattttatctaaaccttgggtgtcataattgagattggttttgccgtcatacacggtattcttggcatttagcttggtttccatgttggtaagggtctcagtactgagctccagttgggtccgaaggcggtccgacgtttgttgcaaggtcttcgtacttaaaatctgataggaactcgtattaatccaagcgggtgagccaatgacttgagtcgactggatgtgtttcatattggcacgatcatgcgtcgctaacccaatgaggtcgttaaagctaaggtcagtttgtaaattacccttcagtgaagtgagtaattgattgtagcgactataggtcttagtctcggcgagtttggcgagaaccgcccgcatgacttgttgttgccgtaattgacggccgtagtcgccccgggggtcctgataacgcatccgtgtataagatagcgcctgtttaccattgagatggtgtttgcccttggttactgtgatgtggtcgaatgaaacgttgagtggactagtgattgtcacgcctccaacggcatccacgatttgtttgagaccgcccatattgatagttgcatagtaatcgataggcacgttgaatagcttgctaacactagccttggccatcttggagccaccaatattgtaagcggcattgagtttttgaacatttgtgtcctgatcaccgaccatttctgctaatgaatcgcgtggaatgctggtaatgagcgttttcttggtctgcggattgatcgtaacgaccataatggtgtcagaatttcccttatcaatacgaccgtctgccccggtgtcaacacctagtagtaagatgctgagtggcttagtcgtatcgattttagtactgctgtttcccgtatagatcgtcgactggtagcgcgcctgtgcctggcgaataattaagccaatcgccacgaatgcgataacgataatgatgccgaccgcaattaacactggccgtaattttgaagatgctgaatgccgcatgttcaaatcctcccttaattaaaggcgttaagatggttccccggataacgtctttgtcttgaaatcactgtttctagcatacccggtcagtacgatcccggaaaatacttattttgagtgtacttaatttaaaaaatagataccacctaaaagaattagattggaaactgagcaaattaggagcggtcacttacggacagtattacggcagaaaacggattcttggcttatactgacagtgaacttaaatatatgaagtgaggtttggtaatttgacagtctttcgcgcattttctaaccaagaagttttagattatttagcaacgcaagtcactgacgggcaggtcttcactgacgaggagacgctgaaaaaatactctttcagtccgcggttgaccgatgacgatagtggccttgccttagcctatgttgaagcacatacgaccaaggacattcaaggaacgttgaaaacggcccgtaaataccacatcgcagtgattccccaagaccaaacaacgagcactgttatcggtgcggacgggttaacggacagtctgattctttcaaccgccaagatgaaccgaatcatcgaaattagcaaggctgattccatcgccgtggttgaacccggcgtcgttaacggtgatctggataaagaagcacgcaagcagggtatgttctacgcgccggaccctggttctaagcccatctctgggattggcggtaatgtggcgacaaacgccggcgggatgagtacggtcaagtatggggctactaaggacaatgtcttaggcgttaaggtcgttttagccgatggtcgcgaagttaagttaggcggtcggacgctaaagcaggcctttggttatgatttaacgcaattgatgattggttcggaaggcacgttaggaatcattaccgaagtaatcgttaaactgttgccgattccgctagggacccccgtgatgggcgtcgcctttttcgataatatgacagccttggctaaagcagtcacggcgattcgaatctccggtgtttatccaacgatgctagaggcattggatggcaatacggttgcggcgctcgatcgttacgaaaagacgcactatgctaagaatagtgcggcgatgttgatctttaagcttgataatggtggtcaggatagcatggcggtcgtgaagcagttactagctgaacaacacgcgaacgatgtcacgattacgactgagcctaaagaacaggcagccctcgaacaattacgacgcgacatgttaccggcagtttttgcaggtcagaaccatattatggaagatatggccgtaccattatcgcaactagccccattgatggactatattcaagacctatccaagcggttggacgttgacatttacacggctggacatgctggtgatggcaatgtgcacccgaccttagtgtggccaacgtcggtaaccgaagtgcctgaaaaaatcattattgcgctacaagaaatgtttaagaagacgctggcacttggtgggacgatttcgggtgaacacgcagtcggaatgttgaaaaatcaatggaacaatgccgaattaggcgaagatgttgatatgttgcaacatcagatcaaagcactctttgacccgatgaatattttgaacccgaaacgtaaaatcaattaacccaacgattacaaagcgcttaagttttgatagcagttgttggtcagatattgcgtaacttggtcatcgtgtcttattattgagatagtcccaaaaataagttgttggttaatgagtcactaagaatgtgcaatgtggattaaccgatgcgaaggaggccccaagtgatacctaagagtgcgcgaatccgaattgaatttgatgccgaagtactccgcaacgagatttttgatgtgcatgacttcgccagttttcaaagtttctggcagcgatttgagaatttcttggccgatcgcatggtcgttggtcacctgaacgtgttagagggccgcggcctgattcctagtgattttgcagatgttgacggacacttagcttaccaagttggtgaagatgcgcaccaaattgcgtatgaccaaattgcgcgtgagtggaccattacgatccgttaaggtagattgagagagaatagagtcttatattggagcgatattgattgagcacaacaaattcccaagcaagtgcagataatgatcagcttttgccagcacccccggaacttttgcaagctgttgatcagttgaaagcttattcgttacgttatgaagttgcgatgaagctcgttttagataagttagattatattagtcgagagtatgagcttcgttacggctacgcgttaattgatagcaagcagtcccggatcaagtcgcctgagagcattgttggtaagatgcaacgtaagcatttaccgttaacattaaatgcggtgtttaataatttgcatgatattgcgggtatccggttgattgttcgtttcctaagcgatgtcaagacagtcgagaatttattggcgactcaggctgacattaaagtattacgagtgaaggattatattcatcatcctaaagctaatggctatcagagtttgcatttaatcctcggggtgccggtctacactgttgatgggccgagcatcattgaggtcgaactacaagtacggacgattgccatgaacttttgggcgtcgttggagcatgaattaaattataagaagaacgttccgcatcaggacgcattgcgagcgtcattgactaagaaggcgcagttaattacggagctggatcaggaaatggacgatatcaagcaacggatgtatgaacctaagacgcccccaaaagaagtctaaaaaatgcccgattatcagcaggtaattgctaataatcgggcattttggggttttcttgacgcgaatcaagtccatccatgcacatgactggtatcttattatagaagaaagtaattaagaagttagattgcttttgcaattaaagggttcatgttacttttaatatgcaagataatttccaaggcatattgataataattaatttgttttgttaacaattgttgccacgtgttgcgaacccagtgtcaagtacgccgttactcggtgattaatgactgaacaaaattttaaaaagtaaaaagggggtactttcatcagaatctttgttcgaaatgactatttactttattttattaagtaaacagctgatgatagcgacatcattaaagataaattaaaaaatcataacaaattggattggtcgcgcggcatgaattatgttatattttatgacataccgttccggtaaactatttgaggaggtctcgtcgatgagaaagtggcaagttgcagttgtcatgttgttagcagcgttgggaagctggtttgcgattggtacccaggcccaggctaagacgtatacgattgcgacggatacaacctttgcgccgttcgaatttcaggtcaagggtggtaagtataagggaattgatatcgatattttgaaggcaattgccaaaaaagaaaatttcaattataaattaaaagcgcttagttttggtgccgccgttcagcagcttagtgcgaaccaagttgacggggtgattgccggaatgaacattacggccgaacggaagcagacgtttgacttttcagacgcctactatacttccggggtggtcatggccgtagctaaagatagcaaggtcaaaacgtttaaagatttgaaaggtaagaccgtggcccttaagacggggacagccggtgcgacctacgcaaagtcgattcagagcaagtacgggttcaaaatcaagtatttcaatgactcgaataatatgtataacgatgtaaaggtcggtaactcggcggcttgttttgaagactatcccgtgatgtcatacggaatcaagaatggcatcgcgttgaagatcgtttctaagcaacacgaagccggtgactatggtttcgcggttaaaaagggtaaaaatgcggaactgttaaagaaattcaacgcgggtctcaaagcaattaaagcggatgggacttacaaaaagattattaacaagtacttgaaatctagtgaagcatccttaacgggtgaagatgcaagtagtcgaacctttatcggcttgttcactcaaaacttggatacgattggttcagggttatggatgaccttggaattaacggttatttcaattattttagcaacgatcctcggactgattcttggggtcttaggcgttatgccgggtaaacttggtccggccatctccagtacgattatttatattttccgtgggatgccattgatggtgttggccttctttatttacattgggttcccagacctgattgggcacggctttaagattcccgcgttcgttgctgggatgattacgttgatgcttaacgaaggggcctataccggagcctttgttaaggggggctttgccgcggtcgacgatggtcaaatggaggcggcccgttcactcgggttgccatactggacggccatgcgcaaggttattatgccccaaggaattcgaatcatgattccgtcgttcattaaccaatttattatcacgttgaaggatacgtcaattctatccgttattgggatcgttgaattaacccaaactgggacgttgattattgcccggaacttcgaaggctttaagatttggttaatgattgcgattatttatctgattatcattacgttattaacatggttatctaactgggttcaaaggaggattaactaagcatggcgaaagtaattgtcaaagatttgcataaaagctacggcgataacgaagtcttgaaagggttaaaccttgaagttcaagataacgaagtagtctgcatgattggaccatctggttctggtaagagtacgtttttacgctgcttaaatgacttggaagttccaacacaagggcaagttgtcattagcggttacgatctttctgacaaggggactaacattaatttggtccgtgaaaatattgggatggtattccaacatttcaacttattcccgcacctgtcagtgttacaaaacatcaccttggcaccgacgcaactcaaaaaggaaagtcaacaggaagctgagaaaacggcgcgtgacttacttgccacggtcggcttgtccgataaggcggatgccatgccgaagtccttatctggtgggcaaaagcaacgggtggccatcgcccgtgcgctagccatgcatccgaaaatcatgctgtttgatgaaccaacttcagcactagatcccgaaatggtcggggacgtgttggacgttatgaagaaattagccgcagatgggatgacgatgatcgtggtcacgcacgaaatgggctttgccaaggaagtggccgaccgggtcgtctttatggcggatgggttgattcaagaaacggggaagcctgaggatgtattcgaacacccacaaagtccccggttacaagatttcttacaaaaagtgatcaacgtttaagtatcggctggtcataataaaataacccgtcaaataggcgcgctaagaattggtttaattcttggcgcgcctattctgtagtaacgtgcttgcatagcagatgaagcggtgttgctctgaggacgattaactagtgaataccgtgatatgggcaacttgagcggcacgtcaactttgatagggtgttaagctggcaaactagttatgccaacttaactaaaaacaacggtcatcccgaaacgggggtggccgttgttttatggctagttctatttagtgttggggcaccttattacggggtgtcaatgtataattactttcaccaaagctaacattgagtccctttttcgcaattggtgtccgcgcgcggttggtcggcttttgccagtgatccaggatcgccgcaatgcaaatacacagtggttctgtggattgatcagtaattgctaattcaaatgcttcaccgttagtggtgacaactggtcgcatcgtcatgattaattcagtaccatgataaacgcggtagttttcggcactcaagcttcccatgataatccagcgaagcttgcgaacatagagcatttcatgccagaagcccagcgttttactaatagaaccgacgttttgacggttatagtataaatcgaattttggcaacaatccgagggttgtttgtcgaatttcggcaagtagctcaccttggatcgcgtataaactgagcgcgtcttggcgccgcccccaccgaccaactaagagatagtgagattggttgtgcgcatcgcgaacaatccgggcaccttgggcgaagctattgcggctgaaatataatttacgcatcttcaacctccgttttccggaaactattgtttggcaagcacttctaagattgctttgccgacaccatcgttgacatttgtatcagtgatatagcgggccaactgtttgacttcgggactggcattacccatagcgtaacttacgccagctaattcgagcatggagacgtcattattattatcaccaatcgccatgacatcgctcattggggtattcagcatattcgcatagcgctcgactgcaatccctttttgcgcattaatattattgatttcgatatttgatgcggatgaagatgtgattttgagggacgaatgttttgccagaatttcatcactaaggggttttagcttagcgggcccttcttcgctgaaagcgataatcttcatgacatgcttagtcggatcatccaataactcgttatagttgtccacgtaattgatgtccataagttctaagcgggctgacgcgagcgataccgcaattttgaacgttgtatctggattcaggttagttaggagatgtgcaatttgttcgattcgcttggctttactgttagagtaaataccatcgttgcctacgacttcaaaatagtaaccttgtgaggttagcgtgtgaaaaacggtgcgggccacgctattggttatgggcaccatgtcgagcattttgccagaagcgtcgtatacttcggcaccgtttaacgtaatcaagggtgccgtgatgccttgagcggccagtagtggctgagcttcagaaaatcggcggccggtggagacgataaagtgcacgccttgctgttgtgcttgacggatggcattagcgttaaaatcggaaacgaccatttcattgttgagtaacgttccgtccatatcagaggcgataatcgaaatcatgttgtcacatccttagttgttttaataattacattttaacatgtttacgtctgaatacagaattattatcattagtggttttggttatgatacaataaaacgagaggtgttaaggatgaaagcgtttattcacacggactggtgggacgtcttaaaaccagagtttgagaagccgtattaccaccaattacacgaatttttgaaaaatgaataccgaacgaaaaatattcacccagatatgtataatatttttcaggcctttgaatggacgccatttgctgacacgaaggtcgttattttaggtcaggatccgtatcatggtcctggtcaggcacacggactgagtttttcagtgttaccgggcgtggcagtgcccccatcactagtcaatatctataaagaattgcaagatgatgttgggtgtacgcccgtcaaccacggttacttggaaagttgggccaagcagggagtcttgttattgaactccgtgctgactgttcaaaatggtgtggccttttcacacgctggtaagggctgggaacgacttacggacgttgccattcagcgtttatcggaacgatcgacgccggttgtctttatcttgtggggtaaggcggctcggtccaagattaagctgattgatacccagacgaatgtcgtgctacaagcacctcatccgagtccgctttcagcttatcgcggattctttgggtccaaaccattttcaaaaacgaacattgcgttaacatccttcggcgaacagccaatcaattggcagttacccgagcacgtcaatcttgagcattaattaatttattggagggttatcacatggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagccgggttcacaccgaatctcgggtgcattcatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaaacggtcacttagtttgttaaacgagggaaacttcagagcttgtactttgaagtttccttcgttttttctataataagaacagttaatttggatgaggagttggaagaatatggaatcaatcacggtaacgtcgccggaagcaaccatggcaatcggggccaaactgggtcaattagtgcaacctggtgatctaatcttactagatggcgatttaggtgctggtaagaccacttttacgaaggggttagctaagagcctgggcattcctaataacgttaagagtccgacttttacgctcatccgggaatatcatcaggggcgactaccgctctatcatatggatgtttaccgcttggaagatggcggcgcggaagatttaggcttagatgaatactttgatggtgacggcgtgagtgtcgtggaatggtcccaatttattgccgaccttttgccagcgacctacctacgaatcgcaattagtcgggataccgacgccgatgaccagcgggtgatgaccttcaagcccattggcgaacactatcaacgactggttgatcaattgaaggagtgacaaccatggcagaagaagttgttgatgtccggcctgctgaagtcgcggatgcggcacaattattagcgctgctcgctcagctcggacgtgagagtaatactttcactgttgatgaaggcattgaggatttgagcgaaacggatgaacaggcgcaaattgcgcgtatcaatgacaccacgaccaacattatttttgttgcgacactcgacgcacggttgattggcgtgagtaccgtgcaagctagtacggattttagtgcggcgcaaggtgaagttggcgtggccgtccttaaagaattttggggcatgggtctggggactgcgttgattgaagaagtcttagattgggcgcgtaattatagctcactggaacgcctcgtgttgacggtccaattacgcaatgtgcgtgccgttaagctgtaccagcatcttgggttcgaaaattgtacggcaacgagctatgacgtggtcgatccgaccggcaaacgggttccggcgattgatatgggtgtgtgggtttgaaatccggaattcacggcactgacggcaaacagattctgatggggagctgagtcggaatctaatcgtaaacgaaccagagcctacctggcgactgcttatgaacggttggcgcatccttcagtcggccagtgaggtgatacgatagctgtgagtattgataagcagttgcgatgcgtaaactaaaaaaagcccagcatcttatggctggactcgcatgaatttcgttttaaccctgaacgcgaacgaagggcttgagttgctcagttccaaaggcttgcgcttcggtgagtaaaatgttggcacaggccaagctatcgtccaacgcattatgatgatgctgcaggtcgatatccagtgcgcgacagaccgtgtccagcttgtgattaggcaattctggatagaagcgctgactggtcttgacggtgtccatggataggtactccggtgcactgatgccgtagtgggcaagcgtattgcgcaacacgccaatatcgaacggtgcgttgtgcgcaatcacgaggcgatcgcgctggaagaacggggcaatgtgttgccaaacttccggaaatttaggtgcgtccgcgacgtcttcttcgtgaatcccatgaatttggacgtttcgccagaaaaagtcactctcgggtttgataagtgtgtaaaattcatcgctgacttggtcatttcggacgactgtcagcgcaagtgaacaagcactgtcacgtttcgcgctcgccgtttcaaagtccattgcgacaaagttcaaagttgccaccaccgtttctaaagaataggattatcgtacaaagaatctcggtgattttcaagttaatggttcgccaggatgatgtcaagttccactggacagtgatcggaaccgaaaatttcgttatggatgcgcgcattcaggagttgactatccaattgttgtgacgtaataaagtagtcgatccgccaaccggaattgttgtcacgcgcatggccacgataactccaccatgagtaagtgtcggtctgatcaggatagaaatggcggaacgtgtcagtgtagcccgccgcaagtagccggtcaaacttggcgcgttcttcgtcagtaaaaccggcactatggtgattactacgccagttcttcaagtcgatattttcgtgggccacgttaagatcaccacagaaaatcaacggtttgttggcactcaggccgttaatgtatgtgagaaaggcatcttcccaatgttgccgatagtcgagccgctttaattcaccacctgaattaggggtataacacgttaagacgtagtaatccgcgtattcaagggtgatgacacgtccttcgtcgtcgaattccggcacgccgataccataagtcacattaagcggctcgtgtttggtgaaaattgccgtacctgaatagcctttgcgttcggcgtagttccagtattgatggtaacctggaaagtccagttcaatctggcccgcctgtagtttggtttcttgtacacagaaaaaatcagcatcgagttcattaaaagtcgtgacaaagccgtgcttgacggcagcacgcagtccgttaacgttccaagagataagtttcacgtgagtttcagacctttcaagtaatttactcatattgtaacacggtagacgtgggttattttaatcataattgaatcagcacaccgtatttaaaccagacgtggcggatagggcccgtgctgaattattgcgaagcacactgattagtttgataggcaggagtgtctttgattgaccgcgtggtagcaggcccgcactagcgaacatgactttcatgcgcggcacactttctcgttgaccatcacggctgtgaacgagatgtttgatcatttgcaatgcggatgcgactgcgaaccctaagtagggcctaaaagaaaattgatggtaaaattggaggaatatcaatgttaaaaattggtgtcattggtttgggcaacattgctcagaaggcgtatttacccgttatggcggcgatgcaagaccagtatgaatttcacctaacgacgcgtaatcctgaaaaacgggcgcaactagcgacgatgtatgggtttcaacacacccatgcgacccttgaggaattaatggcagttaaaccggcggccgtatttgtgcatactcccacggacacgcatgcagcgatcatcaagcagttgttgttggccggcattcacgtttatgttgataagccggtggcgaccgatcttcaggtggtccagagcctgtacgatttagccgcagctcggcacctactattgacgtgtgggtttaaccgccgttttgccccttttaatcagcaattgaaggcgttgcctgataaaaggatgttagtggctgaaaaggttcgcgaagcgggtggtcaagatcccgagacggcagttttcgacctgatgatccacatggtcgatacggggctattcttgttagatgagcccctcgaacacactagtggccggttgacgacgacagataccggggcgttggcgcaaggctatttgaccgtgcagacagctcatgagcaattggaagttatcacgaatatgtatggcggggtcaatctggaacaagtgacagtccaaacgacgggccaacgtgcgagcgtgactgatttaagtactaaaacggtaatgacgacggcgacgactaccacgacggcttttccagattggacaccaacattggaaaagcggggatttgcacccctgattcgtgcatttctgacggcggtagcgacccacgggcccaatccagtcgacccaacgaccgcaattaccagtcatgcggtgtgccgtcatttattaagtgattaaaaagtgataaaattaactgatggacttacaagttttaaccggattatagcgtttcaacacaaccgtgattggtgtgtcagcttaaatcaaaaacgctatgcggttaaagtgattattaacgtaagtgaattaaatcgaaacacgaaaggaacttttcaccatgaccaaagatgtcttggccacttttccagccatcgaaattaaaaaagatgaatcactaagtcattatacgaatactaaaacaggcggtcccgctgattacgttgcgtttccgaagtcaatcagtgagacgaaagccctgattacgtttgctaatgaacaagatttaccactaactgtgattggtaatgccagtaacttgatcgtcaaagatggtggtatccgcggattaacgatcattctcacccgcatgaatcaaattcatgcgagtggtaataaagtcgttgctgaagctggtgccgcaattattgcaacgactaaggttgcatgtggggctagcttgaccggtctcgaatttgcagctgggattcccggtagtgtcggaggtgcagtcttcatgaatgccggcgcgtacgatggcgaaatgagtgaagttgttgaaacggtgacggttttgacgccagcggggcaacttaaaaccctggatcacgacgaattagacttcgactaccggcacagtacgatccaagattacgatgatatcgtggtgtccgcgacatttggtctcaagccaggtaatcagactaagattcaagcgcggatggacgaattgaacacgttgcgagcagccaaacaaccgttggaatggccatcatgtgggagtgtttttaagcgaccaaccgggtattttactggtaaactaattcatgatgccggtttgcagggccatcgcatcggtggtgctgaagtttctaagaagcacgcgggttttattatcaatgtcgatcacgctacagcgaccgattatatggacatgatccactatgtccagaaagttgtatttgaacggtttggcgtccaccttcagacggaagtccggattattggtgaagacgtcgttcaaggttaattatgtcaatttaacaaaggaggcaaccactagatgccaattatcgaattagtgattttactggcatgtttagtgctgctgtcgaacgtattgagccactatctagtcgcaatcccggtcagtttaattcaagtcgggctgggtctaggagtggctttattattaaatgtacaggtaaaattgcaaacggattggtttatgctcgtctttattgcgcccatgctgtacaacgatggcagagaatttccaaaacaggaattatgggaactacgcggggcaatttttgcgaatgcaatcgtcctcgtctttattaccaccatcctcggtggctttttgattcacgtcctgattccaacgattccgctcgctgttggaatcgcgttggcggctattttatcgccaactgatccgattgccgtgcagtcgatctcggaaggggtcaagttacctaaagaaattttgcacttggtcagtggcgaaagcctgattaatgatgcgagtgggctgattgggttcaaatatgcgttagctgcagcggttaccggtacgtttgtgctcggtgaagcagttggcgatttcttctatattagtctggtcggtttggccgttgggctggccctgatcacgatcattcaactcattcgcgacgtgttacgacgagagggtatcaacgatatcgtgttcaacgtggtgttacagattctcacgccgtttgcgatttatttcattgctgaagaatggttccacgcatccggcgttgtcgccgtggttgcggccggggtgttatcacacctacaaaattcacatgaaggtgaagatgcaccagagctacgattagtgacggaacgggtctggaacgttgtggtttacttattgaatgggatcgtcttcctgattcttggtattgaattgccggcagcaacgcaagcaaccattaaaggcgcgcatacaaatacgtttcatgcggtctttgacgttttaatcgtctgggggattttgttactgattcgggttgcttggacatacgcttacatgttgttcaactggttacgacatcacaagaaggccaaacctagtctcagaattgcagcattgtccggtctatcgggtgtgcggggggccattacgatggccggggtcttcacgattccgaccgtaatcgcgtctggcaaagccttcccggaacgcgcgctcgtgttgttcatcgcggctggcgtcattatcgttagtttagtcgccgcggcggggattttgccgctgatggctgccaaatcacttccttttgtcacgcggggatctagtccagatgaagacgacgcggtcttggcggaggaaccagatgacagtgatgatggcagtggtcaactgccacagttaacttataagcaagctcgcatttatattctacagttagcggttcagaatattgaagaacaccggcgaccagctaatcaacgcgcggcctatgatttgattctggatcagcagtttcagatccggcgtctagaagtggcgtcacaaactgcggatgagttggcaccgatgttgacagatgaattggaacttcgcttagtggcattaaatggtgaacgagccgccgtcagagagatgattgcgaacaaacagaccagtaagttagctggccaggtctacttacggcgtgtcgatcggcgtgagcagcgtttcttacaagcgacgcatcgccagggcctcccgacattacgctcattgcggttattactgtcgcgtgcaatgcagggggttcgactatggttagcacctggtgatagcgaagaattgcgggtggcattgttggacattcaacgcgaagcttccaaagccgccatcaaagctttgtcgcagtatctcaagcaggccaacgttgatgaacaacagtttgatcgccaggcactgtatcacctaatcgttcattaccgaaaccgtatcgagaatgcgaaaaatgatcacacgttatcacgtgacgattatgaacaacagttgcacggattacggatcaagagcctcggtgctgaacgtgctggcgtacagcatttgttagagagcggtcaaattagtctccgcaccgcggcaaagttacggcagttcattaattactcggagaacttattaatgctcaatgatattgaggccgatgaagattagttaactttttagattgtaaatcagtagttctaggttataatgatgttagagtagtattgatagtgaatggttaggtctacaaattaatcattacttaagaggacgaataagggcgaccttacagggggaacatcattatgacagaatcagaaattcatgaacgcttcgtggacacttatatgcatattttaaagtatgttggggacttcgtttcggtgccgacccggccatataagatcacgtttgaggcctacacggttatgcggatgattgcaacgagtgaggagccgctgacgttggtcaagattgcgaaagaacagcgggtttcgcggagtgcgattgcacgtcaaatcaatgtgttattagatttgaaatacattgaacaaaccacgaatacgcatgaccgtcgaatcaagtacttgtcgttaacaccagctggccataaagtggaacaagaaattaccaaggcttcagaagaacgctttcatcaatgggtccaagtttatggtgaaaagcgggcgagtgatacgttgcgttatattaacgacgcggagcaaaaggcaacagaactggggttcagtggctttagtggtttgcacgacaagcggggacggcataccgaatacagtgatcctaagacgaagaattagctaatatttagtgaataataagaaacaccgtttgaactgacgattaaatcagttcaaacggtgtttttaattgcgttaagatttatccggtgtttgtggcggcatcgttggcatcgtgaatcgccaagccgcgtaaatgagcagttgaagtaaccacatcattaagacgaaagcgagcatctttggcgaccacatttcaactaactgcttcacaatatactgtggggtaatcagcaagtagatggagtgcaggcggaggaagcggccaacgtaaacgccgacacttgcaaatagaaagagtgcggcacagatgagactacgactggcaggaagccggtgtaagtgcaaccgctgggtgagctgctgggcaatccggtcgacgccccaggtaccaatgattgtagacaccatcattggcccaaccaagtaagcgaaatcccgccacattggtaagtcgaagcgcaagagaccgttgatgccatacggcttcaataggctgaggtggaataaatcagtcattaagtacggtgcattcggatagaaaagcaaccaaatgactgcaatcagccaaaataatagcgggctacgtcggggtgtcagccaaaaactcagctcgatcgggacataagccaaaattgaattaagtaatagaaaatggaacgcgccgtgcaagtcgaccgctgcgaagatgaaaaatccccagaatgcgagtcgcacaaaccaccgctgtaacttagtcatttagtcacttcccttctggtactaattctaacagaaatattaatcaagcaatattaaataacatcaagcttaatatttattcaaaatctagctaaaaagcgcaggctccgctgaaatcgcaccgcgagaaccgggttgccgtgctataatgtgaaagtaaatgattttcatgaggaggaggactatgactttcaattggagcggtttgttgaccttacaaaactttgtccggctccttgacattctcgcggtatggtttgtcatttatgagctgattgtgttgttaaggggcactaaagccgtacaactatttcgcggaatcgttgttattgccattgtaaaggctgtgagtgtcttaattggtctggacacagtttcgtggattatggatcagattatcaactgggcagtcattgcgatggtaattatcttccagcccgaaattcggcgcgggctggagcatttagggcgtggctccatgtttgcacgtggtaagcgtcagaatgaagacgaagagcggatgattgccgaactcgataaggcaattcaatatatggccaagcggcgtattggggcactaatgtcgattaagatggatacgggtcttgaggattatatcgagaccgggattgcattagatgctgatatcaccggcgaattattgattaatattttcattccaaatacgccgttacatgacggcgccgtcatcattcaagataatcaaatcaaggttgcggcggcgtacttgccattatcagagagtaatctgattcccaaagagttaggaacccggcaccgtgctgcggttgggatcagtgaagtaacggacgccctcaccatcgttatttcggaagaaactggtgaagtgtcgattacgaaggataatgagctgatgcggggaatgacgcgggaaaactacttacggtatttccgccaagtcttgttaacgcctgaggattcaaccaagcaaaacgcgctccaaaattggtttggacgagttttcggaggaggtccccgaaaatgaaaaaatttatgaatagcaattggtctatgcggttactagcactgttgtgtgcgttggtgctctttgcctacgttaattcgttaaagacgacgcataatgccagcgttttgacgaatagttcatcgaaaaccacattgacatctaatcgtaaagtgactattagcgcgcccttggaactgaacgtcaatagcacgaaatattttgtaacgggttatcccgaaaatattaaggttacgatcgaaggaccgtccgctttagtaacgacgacggctaacacgcagaactttaaagtctacgctaacttatctaagctggcggtcggacggcacagtgtcaaggtcgaagtcgatggtttgaataaagagttgagttatggacttagtcaaaagtacatccatgtcaatattcagccacggcgaacggccacttataaggtcagtgcggactttaataaagccaatgttgcggacggttatgaagttgggtcagcacggctcgggacatcgtctgttaaagttacgggtgctgtcagcgaagttagcaaggttgccaaggtcgtcgcagtcgttaatacgaacaagaatttagagaagtctgtgaaccagcaggccatcattgaagcactagatgccaatggtcagaatttgaacgttgtcttgacgccttcgaccacgtcggtgtatattcccattacgcaggcaacaacgaccaaggatgtaccaatcgatttgaaggccagcggcaagaccacggcggacaccagttattccttctcgtctgacacaaagtcggtgacggttactggtacgaagtcggcactggcgaagttgaagtccttgccagtcaatgttgatgtgacgaatgttgattcaaccacgactaagacggtcgatgtttcgactagcgatgaggatgggatttcttcagttagcccaacgtcggtcaaggtaaaaattacagttaaaaatgattaatgatgacacttttgaaatgaggtaaattataatgaaatattttggtactgatggtgttcggggaattgcaaactcaggtttaacgcctgaaatggcttttcgtctagggcgtgctggtggctacgtcttgacagaacatgcggaaaacaagagtacgcaaccacgcgttttagttgcacgcgatacccggatttcgggccaaatgttggaagaagccttgattgccggcttgctttcagccggaattgaagttttacgtctcggtgtaattacgacgcctggggtggcctacttagtacggatccaagatgctgacgcgggtgtcatgatctcagcttctcacaatccagttgaagataacgggatcaagttcttcggtggcgacggcttcaagttgtctgatgccaaggaagaagaaatcgaagaattactggatcaaccgaaagacactttaccacggccagcagcagaaggcttggggacagttgctgattttccagagggtaatcttaaatattcacaattcttggaacaaacgattccagatgacttaagcggcattcatttggctgtcgatggtgccaatggttctaccagtaacttagtttcccggatctttgcggatttgaacgtggaatttgatacgatggcgacggcaccagatggcttgaacatcaacaaaggggtcggctcgacccatccggaagcactatctaaattcgtcgttgaaaaaggcgcccaagttggtttagcttttgatggtgacggggaccgttgtatcgcagtcgatgaacttggcaacattattgacggtgacaagatcatgtacatctgtgggaaattcctcagtgaacgaggcaagttgaagcaggatacggtcgtcacaacggtcatgagtaacctcggtttatacaaggccttagaagcagctggtttgcacagcaagcagactcaagttggtgaccgctacgttgtcgaagagatgttgaaggacggctataaccttggtggcgaacaatctggtcacgtggtcttcttagactttaacacgacgggtgacgggatgctgactgggattcagttattgcacgtcatgaaggaaacgggtaagaagctttcagaattagccgctgaagtgacgacttacccacaaaagttagtgaatgttaaggttcaagataagaaagccgctttgaacaatgataagatcaaggctgtcatcaaggacgttgaagatgaaatggccggtgatgggcgcgtcttggtacggccttctgggacccaagacttattgcgggtcatggcagaagcgaagaccgacgaactggttagcgcttatgtagatcggatcgtcgatgtggtcaaagctgaagttggcgttgaataattaagtgatcagaccgatcatcaaaaaaagtcgttactcctagagtcgcgactttttttgttgccatgaaacgaacgcttattgtcaaatgtagcggttggcgccgtggtaagccagttaactgatgagtattaaggaccgctggcatctgtaaatcaattaggccgccaaaaagttacaaaaaaatcgaaaattcgtgacggccttgatttataagcatttgagattggtatacacgctaactaacgcatataccaatataatatattgttgacttttattagatgtaacggtaaagttaacttgtttctaggaaatataccaatcggaggttagactagaccaattgttaattggttaaagcggaatagcgccaggactttagaatctaaagttgacgaggatgacgtttatcgataatcgacgggtgacgtcagggactgcactctacaggtcaattacaaaaaccgactgtgaggttggtgacagatatattgaccacgcagctagaaacaattcaaacagtaaaggaagattaatttatgtgtggaattgttggtgtaacgggtaaagatagtgcagtatcaatcttattgaacggattggaaaagttggaataccggggctatgattcagctggtatctatgtcaatgatcaggatggtcatgactatttagttaaggaaaagggccgaatcgacgacctacgtaaagaagtgggcgaagccgttcatggttcgaccgggattgggcatactcgctgggcgactcatggtgaaccaagtgttgccaatgcgcatccgcaagtttctgcggatggccgcttctacttagttcacaatggcgtgatcgaaaactttgaagacttaaaacagacttatttaagtgacgtgacttttaagtcccaaacggatacggaagtcattgttcaattagttgatcgttttgtgaccaaggaaggtttgagcacgttggccgctttccgtaagacgttaggtctactcggccattcttcatacgggttcttactgatggataaggaagatcctgacaccttatacgtcgcaaagaacaagagtccattattaattggggtcggtgaaggcttcaacgtggtctgctcagatagtttagcgatgttagaccaaacgaaagatttcttggaattacatgatggcgaaatcgtggtcgttaaacctgatgaaatcaaaatcacgaaccaggccggcgaaccagttgaacggaaaccattccatgtcgacattgacgcagctcaagctgacaagggaacttatccattctacatgttaaaagaaatcgacgaacaaccaaacgtcatgcggaagttatcccaagtttatcttaatgatgcgggtgatccaatcatcaatgatgacttgttaacagcccttaaagcagctgatcggttatacatcgtggctgccgggactagttaccatgctggtttggttggtgcaaaattatttgaatcgttggctaacgtgccaactgaagtgcacgtttcgtcagaatttgcatacaaccaaccattattatcagcacatccattcttcatcttcttgacccagtctggtgaaactgctgatagtcgtgaagtgttattgaatgtgaacgatcaacatttcccaagcttgaccatcacgaacgtgccaaactcaacgttatcacgcgaagcaacgtacacgttgttattgcatgccggcccagaaattgcggttgcttcaaccaaagcctataccgcacagattgccttacaagccatcttggctaaagcgttaggtgtggccgttgaccaaccagctgcaacagctttcgacgtaaaacagcagttggcgttagtcgctaatgggatgcaaagcttagttgatgaaaaggctacttttgaaaagattgctaagagtgccttattgaatacgccaaacgccttttatattggtcggggactggattacgccgtctcattagaaacggccttgaaactcaaggaaatctcttacgttcaagctgaaggtttcgcatctggtgaattaaagcacggtacgattgctttgattgaaaaggataccccagtgattgggattattacgcaaaagaataccgctgggttgacccgctccaacttacaagaagttgctgcacggggcgctaagacagttactatcgtcaccgatagtttagctaaagatggtgacacggttatcttgccaacggttgatgaacgattaacggctttgcttagtgttgttcctggtcagttattggcctactacacgagcttaaacaagggcttagatgtggacaaaccacggaaccttgccaagagtgtgaccgttgaataatttaaagtaagtgtgtgggcaccaaaaaacgtcaccgttcaattacggtggcgttttttgattgcccacaaagcttttgcataatttttaactactaatattcataagactattgtgaaagttgacgatcttttggtatgataaagtaagcggttgcgataacacaactaaataattagactattgggggtgaatggtcatgctgaaatataaatattttgcacagccaattaataaccttggaaccaaccggacaatcttgtatgagttattattacgacagtgggatgagaggcaacaaacttggcgaatgccagcgacctttgaaatagcgccaacagaattgattcaattgctggattgcgctattcaggaattaaataaccatcatgtttccatcaatttaacggcgcgtcagtttgctaatcctgactttcaagttgcaattagtcactatgtgcagacgcatttgttaccacgagaactaactgttgagctagttgcgacacctgagctaagtgagttacagcaattaagtgttgggtaccgggcagctggtatattacttgcttttgatgatgttggttctgataacctattccaacagatcaaaatgatgttgccatatgtgaatacggttaaattcgcgttacaaaatatgcgaccgctggggaccccaactacggatgcaattgtttcgacgctcaaattttggtttgataaggcggaggaacagcaaatgctatttacctttgaaggcattgaatcagcggctgatgttcaactggctaatcatctaggcattacacgagggcaaggatattattttgccaaaccgcaactacccgcgacatttatggcatgacaatagtggtatgctacaatagtattcgtagcaatgtaactgagtgtcatgttgatgtttaatcggctgaatcacatgacgagacgaggccgattttgttagtaaatgataaaagatggggtggctacttgtggcaatcaatttaattgcaactgacttgaatggaacattattgcatcaagatcagcgttttgtcaaagaacggtttaaacgggttttggcgcaattacgggcgataaacgtttccctagtactttcgtccggtaaccaatatgcccatcttagacagttatttaaagatgttatggcggataatcttatcgttgttgctgaaaatggggcgtcgatttatgcccaggaccgcttgatctttgatggtagtctttcagcagaccagcaacgaaagtttgtgactgttgatcgtcaccagccactattcaaagacgcatacgtaatcttagttggtagccatgggtcgtatactgagttaggagcacctgataagttagtagcgatggcccgtcagttttatgatcatttacacttggttgcggatctggccactgttgatgataccgttaaaaaaatcagtatctcaacgtcaccggaccaggctgctgatctggtggcacgagctaatgattattttgatggccagttacgtgcgcatgatagtgggtatggcgtcgtagatttggttgatcagcgggtcggaaaattaccagcaattcaattcttggcgactaaacttgggttaactgcagctaatgtgatggccttcggtgatggggcgaatgatgtcccattattgcgctatgcagcgcacagttatgcgatgtgcaacgcaccggcggacattcaagccgcagcaaaacacgtgacggccctggataatgaacatgatggggtattagcaaccattgaacaagagttgttaaataattaaaagcctataactagtcagtaaaaagaggctgtgacataagtctctagaaacaaagcaggtctggaaaaatcttcgaatttttccagacctgcttttgatataatagaaaataaaaaaagagattactaaatatcataagggaaggcattccctatttctatacaattcagaaatcttttatgcatttacacaagatattttacgctctcctgaatcgttaaacttaagtaagtttaaaacgacagactcaactccaccaccaaccatttttccaacgactataccaacttttacaggtttgtattcttttggtttcatgtttccctccgtatctgctaaatcaatgtcgataatttgcttttctatgcttaatacgcattattaggcttcaaaataattttcacagtcaaaagtaaaatccataagtcatacaagctactttgtcgtttcacatatatcaaatccagacgtaccatctcatcgaatcctacaccgttacgtacggtagcctgccatagccccgtacaaccaggtttaatcaacagacgttgtttatcgtattccgtgtactcactgacctcttgaggtaatggcgggcgtgggccaactaaactcatacttccaatcaccacgttgatgagctgtggcagctcatcaatactatacttacgaataattctacccacacgggtaacacggggatcctctctcattttaaacatagcgccactaacttcgttttcttcggtcaactgcaccatgagcttatccgcattggataccattgagcgaaatttaaacatcttgaagggcctttcgccacgtcctagtcttatctgtgaataaaatacttttcctcttgggtcatctacttttatggcaattgcaactattaaaaatagtgggctgagtaaaatcaaccccattaaactagcaagaatatcaaagccacgtttcacaaatctgtaaccatacctacgttggatacgcatttgatcaataattactgtctccaagctattttctccatgctccatcgatatctacaccttttactaatacagtagaacttcgcaattcaatactccgtcctaaaacagccaaaattttttttgctttctaggtactaacactttcccactatcgatctgttcaccattcaacaaatcccgagcgttggttgcaaaacgttcaggatattccgaattcatctcatttaatacgtcataagccttggtcatagcaaagccacggttcttcaacgtgtgcgcatccgatgcgacgacttgaactaacccacacttgacaaattctttggccgttcgctggacctgttccccaaaagtgccaacgagactggtggccgtaacctgtgccaggaccccctgctcaactagcttgtataaacgttgcggctccgcaataatttgagcattgcgttcaggatgtgcaataactggcgtgatgccttcgcatgacaattgaaaaatcatttcatcaagataacttggaaccatttcatgaggtaattccagcagtaaatagtttctactagtatctatacccaacaaatcatcaatattttccattagctgaccgttcagatgtacctcttgaccagaaaaaacggttaatggaatatcatttttatctaactctgcctgaaacgctttaacagccgtttcaacatcatatgcatgattaagataatgtcgatccatatgatgtggtgtcgctaaaatatagcgaataccatctgcaaccgcctgccgcgccaattctaacgacgcctctaacgaaggcgaaccatcatcaatggccggtaaaatatggcaatgtaagtcaactaaattatttatcttcattactgtagtacccataaccattgttatagccgtaataaccgtggtgcgaaccatcacgaacatcattcaaaaccgtacccagaatgttagcttgcgatttctttaatgaattaacagcatcacgaaccgctgccttttgggctataccttggcgaacaactaagaccgtgccatcaactttattagcgagcaattgtgagtcagtcactggcaaaattggtggtgcgtcaacgatcaccaaatccaatttacgcgttgccgaagtcaaaaattcggtcattttattactgcccaatagttcggcaggattaggtggcttaggaccactcgtcatcacaaatagattgccaatgacgggatgaattgcatcattcacatcatccatttggttggctaaccatgaacttaatcccttatggtttttaaggccaaatgtcttatggattgttggccaacgtaaatcggcatcaactaatagaacttgcatcccttctttagcatattcaacagctaaattcccgctcaccgttgatttaccttctcccagcattgcggaagttaccattaaagttcgtaactgatgatccgtagccgcaaagttgatgttcgttcgaatcgttttaatttgttccgtaatcactgacattggctcattaatcgttgtgagattaattggggccgtggtcgttatattttgttccttacgtttaaacatctagcaccctcctaaactcgtttcatcgcttgtgacgatgttcgatcgttatgcgtatgatagccaccattgagatttgaagcttgcttcttcattgaatagtggtgttgatgattaaccaagcctaaactagtcaatcctaattcatcagttaagaaatcagcgtcgtgaacgcggcgatcagtgagcatcctaatcgctgcataaacaactcctaatagcaagccaataactagcccaatcaacatattcagcggtttcttcggcgatactgcgccacttggcgtttcagccggagcaacaatcgtaacgttgttaaccttaacaatcttttgcacttggttcttaaaactacgagcaatttgattggcaatcgtcgcactagctttcgcattagcatcagtcacggcaattgagaaaacctgtgagttgatcgtgcttgtcacactcacttcacttttcaatgtgttcagtgagcgctcaataccataacgcttgcttaattgttgcttagctgggtttaaaactacttgtccagcaattaattccttgtaggtcgtaatcatctgaacatcagcctgctgcccagcatactcagtagcggcattagtatttttacggttaaccaaaatctgaacactcgattggtacttaggtgtaattacaaagaaagtcaaccctgcggcaactatcaatcccaccaccgtaaaactgacaattgcacgccagtacttacggacaagccggataaaaaagtcaaaacttactgtttgatccatcattcactctccaaaattaacaagattaaaacacgttttaactaacgctattaaatataatctatcatcaaatataacatcacattggttgatttacaattgaagtccaagaagtgatctcacctattgactgcaattcaagatttttcatttaccttctgatagagggttccatgatagtctctatcatgtttttttatcggccaaatagtcaatcaattttaatagatattatggtgatcatccaacataacccttatatggtaacttgtaagacgctttgaatctgtttttgaaacatatgtgtgatgcctatgtttatacatagttatcatattactaatctttaagctttgccattttttaaatagcacgcctaaatagatggagagtataaaatagtttgtgtaaataaataaaatcctattgaaaagggaatcccttccccgtatgattaaatcgtcaaaccaaaccaaaacggagggattccccatggaacagtttaccaaagatttaaccaaaactctattatcaaatggcgatgttaaagaactttttcgccaacaacttgaaaaagctattaatcaaatcttacaagctgagttaacttcgttactcggttatgatccttatgaacgtaatggttttaaggctaacaattatcggaatggtcaatactttcggttaattgattccgaatatggtaagttgaaaattgctgtgccgcgtgaccgacaaggcaagtttcataatcatttacttccagcttattctcgtcgtcaagatgctttagaaactacaattattcaactttactctaaaggtgttaccactcgtgaaatcgctgatttgattgagaaaatgtatggttcttattattcagctacaactgtttctaacattactgctcaagtaactgagcagattgaagctttggtagcgtcaagaatcttgtgtaaatgaaatgccttcgtataaaagtagggtttaatacgcgttatttggctgcacaaaaactttaagcgtcttcattataatttcaaaatcaagccacaaactacgattagctatgtatatcaagtctaatcgtaacattccatcaaacccaacactatttcgaaccgtggcttgccacagcccggtacagcccggttttacaagtaatcgctgtttggcatagtcagtatattctgcaacctctatcggcaacggtgttctagggccaactaaactcatgtttccaattaacacatttaacaactgaggcaactcatctacactgtgttttcgcataaaatggccaatctttgttactctcggatcatcttttattttaaacattgcccctttgacttcatttttactttttaaatgagacaacattttatcagcattagacaccattgaacgaaacttatacattttgaatggcgtttcatttattccaaggcgtgtttgcacataaaaaacgttttctcttgggctactgatttttattgcaataattaatattagaaaaacgggcgttaataaaagaagtgctgaaatactagcaactatatcaaataggcgtttaataaagcgataactcaaatcattccttttgcttctaatatctataaaaatatgttctattttttctctatcttgcatagggtcacacaacctttactccgataaaagctttgcaactgcactcttccagtcagaaattataaatccagtttttttggccttgctcaagttcatcactgaatgccgtggccgacaagccttttgtggaaattgttcagaagtaactggtactacttcaacatcagtgttcttcaaaatttcttttgcaaagtcataccaggtggctgtattatcgttgcttaattgataagtccctgaagcggcctcagttttcactaggtgaaccataaattctgctaatgttcgcgtccaggttggccgtccaagttgatcattaacgactgtcaacttatcatgtgtcttcgctaaattctgcattgtgaagacaaagttatgtccaaattcaccgaaaacccagctagtccgaacaatataataatcagcaccactgtgacgaacggcttcttcaccagcccacttagcacgcccgtactcattcttgggattggctggatcatcttctaaatattcacctttattggtgccatcaaaaatatagtcagtagaaacataaaccaatttaacatcctgttcagctgctacttgggctaaattttttgttccatcaacattgaccagccaattgagggctttgccttcatcttcggccttatcaactgctgtgtaagctgcgcaatcatataagaccacaggttgtaattccgcaaccttagctttgactgcatctaggttcgtgacatccaattcttttttagtcagtgcatcaaatgcaatcccttgttcatttaatagtcgttgcaactcattccccaattgaccattggcaccaacaatcattacttttgacatttagaaacctcctcctctagcatttcacactattattgcccgttcttggcgtagtttgattcaaccttgctcttatctgcttgccaccagtcttgatggtcagtataccaatcaatcgttgctttcaacccagaccggaagtcagtaaactctggctgccaacctaattccgtgcgcaacttagttgaatcgattgcataacgtaaatcatggccgggacgatccttaacaacatcataagcatctttaggctgacccattaattcaagaatcatttccaagacgtccttattgttcatttcaccatcggcaccaatcaggtaggtctcaccaatcttacccttggttaaaatatcccaaacggccgcagaatggtcatttgtgtgaatccagtcacgaacatttttaccactaccatataattttggccgaataccacttaatatattggtaatttggcgtggaataaatttctcaatatattgataaggaccataattatttgaacagtttgaaatagtggcttgtaagccaaacgaacgcacccaagcccgaactaagagatcactgctggccttagatgaagagtatgggctggaaggcttataccgactagttggtgtaaacttctcgccaacaccctcaccatggcccggtaagtcttcccgtaatggtaaatcaccgtatacttcatcggtggaaacatggtggaagcgtttgttaaacttatgtgcggattgaatcagcgtataagtcccaataatattcgtttcgatgaatggccatggatccttcaatgaattatcattatggctttcagcggcgtaatggacaaccgcgtcagtttgttgcattaattcatcaactaagggcgcatcacaaatgtcacccacaactaatttaacccggtcgcctagaatttcttccaagttggcccgattaccagcgtaagttaacttatctaatacggtaatcttgacttcgggatgatgattataaacatagtgaacaaagttagagccaataaaaccggcaccaccggtaactaataagttttccatgacgtctccttaaatttcgccgtaaacaaacggattgttctgttcaaattctttaaaggtctgttgtttggcatccttatcagaagtaatagcttgatcatagtcaataggccagttaatatttaaatctttatccataaaggtaataccaccatcagcttcagcgttgtagtagttatcacacttgtataagaaattaacattatcagtcaatgtcacaaagccatgggcaaaaccacggggaactaacaattgacggtggttactttcagagataatatagccttcccattccccgtacgtaggtgagccagcacgaacgtccacaataacatcaagcacggcaccagtcaccacgcgaattaatttagtttgcgctgccttgccacgttgaaaatgcagtccccgcaaaacacccgcttccgctgataacgattgattatcctgaatgaagtcaaaatcaatgccagcttctttgaagtcacgatccgagtatgtttccgtaaagaacccgcgcttgtcgccaaaaactgctggctcaataatcttaacatcttgtaacttagtcgttgttacctttaatttgcccaaaatttaagccctcccaattaatcttaataagtattgaccgtaatcattcttctttaatggttgcgccaattcatacactttatcagcatcaatataacccattcgatacgccacttcttctaagcaagccacttttaaattctggcgtttttgaacggttgcgataaaactacttgcttcttgtaatgagtcatgggtcccagtatcaagccaagcaaaaccacgacccatgagttcaacatctaactcattatgctctaagtaaactttgttgatatccgtaatctccaattcaccacgtggtgatggttgaatattcttcgcaatatcaacaacttgattatcataaaaatacattcccgtgacagcataattactagctgggtgtgcaggcttttcaacaatggactttgcatgcatattttcatcaaagtcaacgacaccaaaccgttccggatcattgacatggtaaccaaagaccgtggcccccttcggcttagcgctagcatgctggagcatcttggataagccgccaccataataaatattatcacctaaaatcaggcagactgaatcatttccaatgaaatcagcacccaaaataaaggcttcagctaaaccgttcggcttttcttggacagcataggatagattcaagctcaaatcatgaccatcgcttaacagttctttgaaccgcggtgtatcaacaggtgttgaaataaccaaaatatcttggattcctgccaacattaacgtcgataacggataataaatcattggcttatcataaatcgggatcaattgttttgaaatcgcccgtgtaattggatacagccgtgtaccggatccccctgcaagaataattcctttcatttagagccctcctgaatagttgcttattttaattatatttctattttcaaaatattactacctaatgatagaagaaactatggattgaagtcaatatttgagacaggttttaagagacattcagaaccgcgtttaccttccacagctcaaataaatcattaatcgcgattaataacttatttgaaccctggaaagcattaaatcaggcggccatttggctcgtaagtgttgcaatttcaacttgtaagggggtctggtagcccagtgaactatgaattctcttcctattgtagaaagcatgcacatattcaaaaaggacggcagcggcagtttcataatcttcaaagaccggcactggataaacacattcctttttgagggaagcgtgaaaggattccattggcgcattatcatacggacaacccttacggctgtatgagtggcggatatgtagttcagttaaacgttgattgtaatcatcgctggtatactgtgatcctaaatccgtatggataatcaggtccccagtaatggttcgatttttaaccgcgctttcaagggtctttaagactaaatcagtagccatcttttttgagaacgaatagccgataatccgtcgtgagtgcaggtccatgatggttgataagtaacaccagcgattacgcttcgtttgaatataggtcatatcagcggtccatttttgatttaaaccagtggtcgagaaatcctgcttaagcaagttgggacgctgttcaaccttggttttggaagccgaagccgctttccacttattgacggtaacggagtggatatccagttccttcatgagccgggaaatccgtcgtggactgcaccgaagctgcagtggttgaagttccagattcaattcatggtggatcttcataacaccgtatcgctgcttaaattccgcaaagatccgcagaatccgttgttttaagtcctcatcttcggcccggcgttttgaaggctttggggatcgataacgataatactgagctctggaaacaccgaggattcggcacatcttggttacctggtggtgatggctttcttggtgaatgtaatcaaagatattggttacttctgcgcaaggaagcccagggctttttttaggatttcgttctcctcagatagcgaagccagtcgcttttccatcgctttgatttcgtctggcgatttaccggattgagttttgccctggccctggatccacttatgaacggttgaatagccaatgccatattctctggccagttgggcagctgattcgccttgcttatataggttgataatgttttgtttgaattctttgtcgtaacgagttggcatgtaaaaattccttccttttgagagacgatttattcattatacgctctcttaaaagttgtctcaggaatcagcttacatccagttatactagacaaaagatcagctcctaaaagatgggtttgtggtaaacaccattttaaaggaagctgatcttttttgtccgaacagcgttcggattaattttacaatctacccaatataaaatacattatgggctaccattcataccaattaaccagtcgctaattttttgattacaagtgcatgcccccatcttcatgccggtttcgagtttggtgttgccgttgctttttcgtcatttcccactcggtctcttttaagccacgtagttgctgctttcttagatagtccgtgttcttcgcatataaaatggttattaaggcttcgtccaaaatattagtcaggtagtttttcgggctagttgggtaataattaatggcctgatagtccttaatttggtcttgcttatattgatcaaaccgtgttgtctgttgtttcaaacgggcttgcaccatttcaatttgtttgtgattcaacttaggatcttggccacattcgccgataaacagttgccgggtgccatcatgttttaagacccgttgcagtcgatgatcctgaatatcttttaattccattttacctaacaggtaatttaaaccggcttggtgttgctgactagtaaagactaccggtggctgctgttgcaattgactaagatcatcggcgcttaatggctttaattctgggtcatagtaaaccacagcggtatagatttgctccttatcaatcgtctctagcttatccaggtcactgttcggaaaagcagtcgttagaatgctgttgtattgggtttgcactacggctttaacttcccgcatgacccgtaaatttttcaccgctttagaaatgaattcgagttcgttaggttgataagcggctagcatgccccgatcagtatgcttcaaatcgtctaactggtgaccgtgtttggctagtaccgtggttaattgcttctcaatcgtctgggtttgctgattaactaactgccagctggtatatggccgcctggtaaacgtcaataattgctgagttaataagtcgttttgaatatccgctaaccgttctgccaattcgccacctttgaaaatcgtttgttcactattagtttctttaatcagttcccgtcgttcagccgcggttgtctgttcaaaattaagttccggataaagctttttcgttgctcgttccaccactttatttaacaactgattagcttgttctagtgatgtcgtttgctggtcaatggtcagtagttgtttggttacatcttcaccaaccgcgtgtttgattaataagctgttcttccaattaaatagcatgcgctgtttatcgtctaaatgttctaaatcgacataggttttcaattgctgacttagatgactaattgtgtgtttttcagagaacgatagctcgtcagttaacgcgtcaaaatgttcatgatttcttatcttttcgtcaagattatgatatttagcttgagcgtttctttgcgctctaacttgttgattaaatgcttttcgattttttctttggctgttaatgccttcgtgttgggtaggtgtctcttgaatcccttgatcgacaaacgatttttcactaatccgatccggaatatttttttgtgctaagaactgattaacactcaacgcccaattatgccgccactcattaattttttcctttttatcccaatcaaccaaccaaatttttctttgttttggaaacccgcttttggttaaaagttgcttgccattttcatctttaatgtactgcgtctttgcttttaatccccaactaccatcggggttaaatgggcgattggttaacatcacatgtgcatgcggattgtctgggtgatcgcgatgaattgctacgtcagctaccataccttgatcgacaaaattttcttgcacatattttgtcagtaattctttctgttcggattcacttaattctaccggtaaagccacgttaaattcttttgcataccgtgagtttgatttacgatcgttcttttcaacttcattccataatttttctcgatcactggcccattctggtgcatttttgggggttaaaataaagatttctggcataaccgagcgggcataaaaatagtggcggccttcttgattatcaaataatttttcaccacttcgataagcggcactggcaatcgcacttcgtccttttccagcactaatattactaaaactcatatgaaatattgccatgttagtcacctctttactttgattctatgggcttgactttgttgtcgccatcggcgacttctaatacaggtttttgtgggttagaataacatagaatttattctatgtgtaagtgcgcattgacctcgtttcactcggtcttctgattctcttaactttaacttagtgtatgccttccgcttagctatttcaacttttatcctttgacttaacattctctttatgatatagtgtctgtgattatttctaatatgattggagggatcgttatgtctcaaagtaacttagaaaaacaagaagctaaattaaaagcccttaatcaaaaaattaaggacgaaaaaaataagattgaacaacggctaggtaaacaaatcatcagtcaaaccaatttagattatgctaatttgtctaacgatcagattaagcttttagccaagcaattttctgaatttttaaaggtaaagtccgtagatcattagccatacgagatggggaaattccatgtctaatcaatatgaaaaactagtcgagcagcaagcgcgtttaaaacaaaaaattgagcgggaagattttaaattacggcaatctaaatactatgaaaatcggcaagcccgcaaagcccgttctcgccgactaattcaaaaaggggctttattagaaaagtactttcaagctaataacctctcggtcgaacaaaccgaagaacttttaaaaacatttgccgattacgttaatgcccataaaccgaataaactcaaaaacgatcaacctaataactaggccgatcgtttttattttctggatcatttttaggcttgatttctgggttctgatccacaaaatcttttaactgtttttgaattcttttactagttttgtctttaactgatttaagcgctaagtttgctctaatttgtaatccttgaatgccattgtcatatgtccaccgtttaattttagccatgtcattagttcgataataattggcaattagttcgttccattgatcccacttatctaacggcacattgattaggcctgcaccaccgtcaatcataattttattagcacttaaagtcgccgtccttttgttcccgtcccaaaagatttgttggcgcatattatgatacatgacagtcaatgctttatcagtaatcgtcgttcgtggatcagccaagattttttgtaaaaaggattgttcttgtttttcgttaattaaaggtggttcaaaaaagtcttcactacctaaatcaactcctcctttcccttgccgtaattctcccggtactaaggcgtcttccgctgccacaatcttgttgatttgtttttccatggttaacgttaaaggggaattttgagcagtgatatattgccacccacgctttaaattaacaatcgtcaaaacatcttcaacaggtactcctgctacgctcataccgtccataatagtttgtgtttgtggcaaagtggtattaacgccttcaaaacgagcattagtatgcactaacttggtaaagtttgctcgggcaaaccgttggttttctgcagctgtgaatttatacttgtccatatatgttcgagttttagccatattttgtgcctcctttctatttcagtcactgattatttgacctgtccatgttaaatcacaaaatgcttttcgttgataatttgctcttggcgtttatctaagaggtaagtgggtaacgcgtcaaacagcttgcgtttatcaggatctggattatatgccgcttgttcccaaatgtcttgaatattgactgcccaggggtcagccaacaattgatcaattgttgcgatttctttgctgggtttggtcatttaaaaagctcctatcccgtttttctagctcagctatcgtcaattcggccacttaaggcacctatttttacttctaagcgattttaaagcagttttaatataattatgcatgtaacacttaaaacggcttaaatgagtccatatgacgtttaatttcaagaacgctcattgtcagttttctgttcttcggggtgtttggccgcatattctctagccgcttgtttattccaccaaacgccaaataggttttgcatggtgccgtacaagtagttttccacgttcttgatatgcttttcattgcttcttagggcgttaaagtagcgtctcaaggctttagtcatcaaagattttagttcttcatcgtctagtgggattagaacgccaatgtcctgatgatccttctcaactcggtacttagcatttaagataatgccaatgaaccggcgcatttgttgtggagttcggcaccagaagctaagtaattgcacggcttcgggttctaagaaaacggggagcctactgtcttcatcagttaagaagtcattagcatggttcaccaaatccttgttttgcttttctagttctgctggtgagaattgggctgtggaaaagtccaacttttgagtatctatattatatctattagtatctatattattagtatagtctagatcttgtctctttttgagaagtccgcttgtaccaagagattcagacgtatcagaaacggtatcatacgggtttctctttttgagaagtccgcttgtaccaaggggttcaacggtatcatacgggtttctctttttgagaagtccgcttgtaccaaggggtttaggcgattttattggctctcgcttaatataaacgtcttttgctgttacttccaaatctgccaaatataatctatttggttcgtttttgcctgatcttggattaaaacccatatgtttttgatacaaaaggtttgcgtccattaattcgtgtttaatcttattgattttattatttgaccagtttcgtaaatcttttagttcattgtttgtgtatatgaaatatacgttgttattttcgtcaacccaattattgcttagtgagtaacttagacgatcgcgtaacaccgaataaagtaaaatggcactatcgctaagatccttatatttttctccttggagtaagatctgcggcaaagcgtagaactttacttcataggctcttttagcatttgtaaagttaaattttgattgatccataataaaagctccctttcttaactgacacaggccgtcttaaaagagagttgctaaaacatctgacttgttttaaaatacaaatctgatatgctttaactgaattacaaagcgaacattggacgtgatcggctttgtaaattcaccggcatgtgtctattcgggttgcctatacggcaacttttttaatttctaacaacaaaaatggactaaatagcattggttagctacttagtccattggatttaatttgtttttaactatccttcacttgtcccataggactggtttgcggtataattaacctacaaattaagaacaatgttcagacgattttaacttggcggtctaaattgtctgaatctaagtagctctctattagctacttgttaaacctaaaatccccgattcctcgtgaatcggggatttttctgtttagcttgatctctttatttggttgtcaaattaatcttagtctagcatagcgcttacttacaggcaaccgtatttggttcagtgcactttactagcttttacctaagcgcaaattaatcaaacaaataaattgtgaatttgcttgtttgattaattatttatttaattactaaattgcatctatgattgaagctaagaattctgaacgatttttaaatccgttttttcgggcagccgtatccattttttttagttggctttcagtaattgagaaggtaactgatcgcttacgctctacttcctttcggctgatatttttcaaaaatgcgactgcatctttcttgttgtctttcaatgtagtttcgtaactttctctcatttcttcgtcttttttatgattgaatgaatctaaactcataatctaactctccttacttggttttatttgctaattcttgaaaaagatgatcggcgtgttctatgaacttttgattttgctttaaaatggattcatcatgattggctaattcaaatattgaagcgtgtcttgcagtagctttattaaagagctctctttcaggaaatatagttgcgactgtttcatcgccttctatgtgttttagcaaatcgcgagacatgcttgtattatgtctaatcatattaccgataaagaaaagctttgcgtcaacgtaagtttcgccagttcgataatcaaaaagtgattttctgaatttttcgagtcgtgtttctaggtcaaacttggcattgtagccatgttcactgggtgtaatgggactaagcaggtaattactgatagcaatagcgtttttagtgatggtgctaaaatctgggtgcgtatcaattaagatatagtcatagtcggttaagcttaatgaatcggagttgtttttaacccacatgaacaacatcatttctttgttactgttattttctagataacttcctaaaacatctaggtctataaaaccggctattaaatctagattcggtccgacactgtcaatttttactttttgagcattgtcattttctttaaacgcttcagcgatggtattgtttcgtcgtgtcttttcaaaaacggttgttaaattgcactgatggtctaaatcgattaatagaaccttcttaccatgtttggctaaccaatcaccataatttaaagtcaaggttgttttaccaacaccacccttgatagcagtaaaagtaataatcttcatcttgatacctccttcatctagcttaattatatcattagtagacaaacaaataaacaatttattaaataattaattcgatggctttggccggcttaatcacgtacttcggcaatatcaacatcactcattctcggctgataaggcttaaactagtctgatatgcttaatacttctttactgtatattgatttaagagagcgtaaaatatcttgtgtaaatgcataaaagatttctgaattgtatagaaatagggaatgccttcccttatgatatttagtaaccacagaaaacatcacaggaggcattccccatgaatgaacttaccacagaaattatcgctgcactagcccaaaagcaagatttggacgaagtttttcgtcaccacctcgaaattgcgattaaccagctgcttcaaaccgaattggcagagtttttgggttacgaacgctactcatacgctgggattaacactggtaataaccgcaacggcagttatgagcgctcgtttgatacgaagtacggccaacttaacttaaccattcctcgagatcgcaatggccggtttgaaaatcataccttgccagcctacggtcggcacagtgataatttagaaacaacggtcattcagttgtataccaagggaattaccactgctgaaattgccgaactcattgagaaaatgtacggtgctcactactccaaagccacggtttccaacatgactaaagccgtcaatgaacaggttcaagctttccagcaacgtcgactggcttcacaatacagacctatcccaaattaatcaaagatctgcttaaaatgccgaatttactcactttcatggactttccaccagctatccggcaatcactatacgccactaacctgattgagaactttaataagcatctcaagcgcaccacccaccacaaagaacaatttccaacggaagattcactggatcgcttcctggtttctcagtttaatgtttataacgagaagtctctgaagcggatccaccgagggttcaaaggactccaggacaccttggaagcatcatttatttaagttagatacatattatatgtacgaaggcatttcatttacacaagattcttgacgctaccaatgattttcaaatttataataattaatagtattgttagccattggtagccaagccgcactcaacccgagaaataaccctgaaacaagctctaattccaaaaatgacaccccaactaaaccaaataatgaacctaaaaggccacaatagatagctagttttagtagtatatagctatttatcttagttcttatgccacgaataaaaaaattccggttgttctaaacgtgtaaaagatgacaaatggaaaaactgcaacaacaatatgactacttacccatttcaaaaaaatcatagatgataatacaacaactgtactactgataatactgagcatagtatttccgatagactgaatatttcgtttcataattttccccgcattatttcaaaaaatagttacttgatacttgtcaaaacttaaggcttgtaaaaaatacacctattggtttcaaggctgtctcaatagtaaaactataaaatttgaatcctggccgttttcacatatattattgttcaatacccaactgctctacgtgatcaaaacaacaattttctaatcagtgactagtagattatagccgttttttcatattaaaacggctattaatttttattctttactgtgctgccaattaacatggtatcttttgcgttgataactaaagccctctccaaccacttcatgggtatccagtaccgtcacaaatgcccgttcatcaatcgctttaattaattgcttcaattgtggaattttccgcggttgaaccaccaaataaatcacttgcttttgatcatgctgataaccaccttcagcttgcaaatatgtcaatcctctatttaaagaaacataaattaattgggaaattttttgtcttttggtagattgtgaaaacaactttcattttcgatttcctgtaacgatcatatgcagtcaaaaatgatcgaaaaaataaaatattatagaaacaggtttagaggttaacataatgtgacttatcccaagtaacccgctcactccctgataaaacaacgatccgttatttggcctttgtgaaatttgacagtagaggagtggtctagatgaaaaatccccaaaaaatcagtaaactcactttgtgaatttaaccgcctaaactcctagaccattgcgccaatcgtgcctgacaccagtccaaaaaatcccgttctgaaatcgttggtgttcccgtcaataacttttttgtgatgggctcctcacctaaagccgtctcaattaacccaaccactaaataatctgtctgtttcgtaacccaattttgtggtttcgccccaaagactttcgccaaactaaaagcttgatcccgagtcatggtagttagacgtccggtaaaagcaatctcacaatctcttaaatcaagcattttaaatcatcaactttcttgattctaatgttggttttgacttgacgggttatggttttccattcagtttagagggagtgacgttttgagcgcagaattgttccctggaaacagctatttggaataactgaaccagagtgcaattctacgctaaggtttccccctagttcgtcggtcgttaacgcccgtcgcttgtctgtacaattgcggtattgctaccaccactcattataaacctacgttttcggtttagcctactaaaaaacgccctagaaggcgttgatgatacgtatttatttttgttcgatcaccaactaatcaatggcaccaagccgaagcttcgttttaccacccgcgccgttaatggtcgcgctcaccattcaccacccagccgtacagatagccttgttgtggtatagccagacttattgaagtcgcactggcaaacgtgtccccttggatttagaccccagcttgtcccctagggctttaaaaatcgcaccggccatgatataatagtcagtaacttagatgacttttatgtggcgctcaccgattccagtcggtgggtgtttttttatgttctattttatgaattaaccataccactattcagcttgtttataaacaaaaatcgcaaaaataacaaaagtaatttgtaacaagtttcatgtaatttgatacttgtaatttgtatctttatatttacgttgaattgctatgctcgttgcattacaatgactatgaactaataagttcaagtctggaggatcctgtatgaccacatcgatcacgataggaaactttaaaggtggagttggaaaaacaacaacttgtgtaaccttttcttatctattaaataaagcccatagaaaaaccttattaattgattttgatccacaaggaaatgctagtgaaattatagaaaaaacatttcctgtattcaaacaaaaaaattccaaaagtttaactgatggtattaagaatctggatttatctgagtccattgcacacgtcacagattaccttgatctgatgcctagtgattggagcttatctttgcttcctgatatgcttgaagattataagaaaagtgaccgaccactatttttaaaaactttgctaacaaaaattagaaatgattatgattatattttaatagacgttccgccaacgctatcagcatatacaaataatgccgttttagcctcagattacgtaattatggttatgcagactcaagagcaatcttactcaagttctttaaaatttgtaagctatcttcaagggcttagaaaagactatgacaaatcatttgatttgcttggcattattgcctatctggttaaaaaagacggacctgtcgatcatgaagtgttgaaagccgctaatcaagcctttggaaaagccctatttcatgggaacatatttcaaagagaacgtgttaaacgtttcggaaaaagtggaattagagatgaggatatgtgggacaaaagggctttatatatgtatcaagtagtattagatgaagctctatcacgaattaatctgttggaggggtagaatatgccggaaaagaaaagtcttttagatcagattgatgcagagagtcaattaaaagatggcgactctccttttaaacgaaaagaaaaaacaaaaccattacgagttagagaatcattttacaatgatattcgaaaaattgccttcgaagaaaatacaaaaatggttgagattttagatgacataataaagcgtgggcttcgaagctataaaaagagtcacccagatacagattacaagtaacttgtaatctgtaacttgtatcttgtaataagtaacttacaattttaatttaatctgaacaaaatacgcttacgactcaaatgcaggctttggaatccagcgatgctaacaaagaaaaaagtaaataattacgcgctctcagacaacacgttcaccttttagatgtatacttgtccgtttaaattaagcaaaatgcgtttatatcacgttataaaatcaaaattttattagacaataaaaaaacaccactcaaattaatgagtagtgctttttgatatgcaattggcataaagatctgaataaatggtagattgtaaaattaatccgaacgctgttcggacaaaaaagatcagccttcctttaaaatggtgtttaccacaaacccatcttttaggagctgatcttttgtctagtataacctattccgaacgaattaaaatcgaaaccttttgtgaactagggctgtccaatattaaacattttgatgccaaaataaataataataagaccaagaaatggcgttaatacgcggttgaccttatctaaatttaaatggcgaatcacgagtggtgtaatgattgcgccgataattgcgccaatcatgaggaccaatcctgattgccaagcaaaagtactggtgaagaggtggccgattaaactgattgtggacataaccgttaacacgtaggtggcagtaccagcggcttcaacggccgttaacccaagaattgctaacccggcagccgtggtcgcaccaccgcttaagccgccaatgccgaccatcaatccacttaaaaggccaaagaaggcagcttgccaaggttggtgaccggctgtagtttgtttagaatggtgaacatacttgattagtaccatcgcacccataatcaaaaaaattgtcccgacaatccagttatacagttgttggggaataaattgtgcgctgaatgtcccgacgatgataccgggaacggccgcaatgatcatttgattgccaatcttgaaattgacatttttgattttcaactgtgttagaaaaccaaagaataaggctggtaaggcgacgattagggaggttggtacggctaccgcggttgcaaggcctacttgactggttaagacacctaggtatagggcagcacctccgccaccaatcagactaacgaagatgccgattagtaatccggataaaaagacaaacgtagtgaattcccccttagattgtataattataccttaaacggagtacactccgtttgtcaagcgatgcgtaaaagtgtatggtgaacttaagtaaataggagggtgtgtcgaatgcgaaaggatgcacaaattaaccaacagaaaattttgactgctgcgcgacaactctttgccgcgcgttcaatcgaaaccgttagtatgaaagatattgcgacggccgctggtatcggtcccggaacgttgtatcgtcactatgcccataaaagtacactatgtttggcattggtaacggaccgagtcgcaacttttattaaaaccaatcaagtctacttgaccacgacctcggtaggtgcagcggcacgttttgatcatgttattggggaatatttagcgattcgtgagcacaacatggcgttattaatgaatgtcgaggccggtgaacctggtcgccgtcaattttatcagagcgaactttatcaacaattatgtgacctattaacgcaactggttcgtgatttgaagccaacgctttcgaaaccggcatgtgagtttcaagctgatatgttaattgccatgctgaaggggactagttatgcttttcaacgtcaatggcgaggacggtcgcagtccgaactattggcgcaattgcacgcgttaatggtgactgaatgatgttcactattggcactagtggtttggcgattaacagagtgggttgattgttaaatcaaaaaagatggttctaggcggttaatcctagagccatctttttgaatgagtcgtttaagcaggtgtcaccacgtatttttcataacgttgggcatcgacagtgttgagttcgactgttaattgggtgccatcagctaagtaatccgttttgagaatgttggcgtggtcattcaagtaagccactacttcaccatcattgaacgggattaataacgttgttgtcacgtaattcttaaagactttggctttgatcatactggtcaaagcttgtagtgaggcctcatcacgcgccgtatagatgagttgatcatcttgctggttcgggtagtcggcttcggttaaatcagctttattgaaggcataaatcataggaacatcgtgcacaccgatttctttgagcgtcttttcagtggtcgccatcatttccttgtaatggggatcggcgtagtcgatgacttgaatgagtaagtcagcattggcagcttcggctagcgttgaacggaaggcgttgatcaagttatgcggcaagtcgctgacaaacccgactgtatcactgagcagtaactgcttattgtcagggaaggttaactgacgaatacttgtatctaacgttgcgaaaagcatgtctttttcgaagacttgcttatcttcacccttaccgaacagtttcactaaaccattcatagtcgttgatttaccagcgttggtataaccgactaaagcgacgttggggagcccagctttatcgcgttgtgaacgtcgcactacttcgtccttattgagttccttaagttcgtgcttcgcgtgactgatccggtcttgaattgtccggcgatttaattccagttgcgtttcaccagcaccacggttggtaaagcccccgccaccaccagcagcggccccagcctgttggtcaaggcgattggagatactcgttcgtaatcggggaagttggtattgtaattgggcaatcttaacttgcaatttggcttccttactccgcgcacggttaccaaaaatttctaagatcagaccagtacggtcgatgatctgaatgtccgtttgttcctctaagttacgcacctgactaggggtcagatccgcgttgatgactataatgtgcaaatcgttggcggctgcgacttctttgatttcgacaactttacctttgccgaagaaggtggccgggttgggcttttccaatccttggtcaattcgcagggccgcgtgcatattattggctgcaacgagcgcttctagctcggacatggcgtagtcgtaattggcgaccgttttagacatgccggcaatgatgacttcttgtactttttgagcgttggtttcagacatacactcactcctaacgtgttatgattgcattaagtataacatgtctaatcaaaatattacgacttcgggtattagggaggaatcaaaaatgggttacgtgcttgatttgcggcggcgagttggccaccaaccgctagtagtggctggtgcggctttaatggcccaaaattcgattggtaaaattgtcttgatttatcgaaccgataatcactgttggggcttgccagctggatcgactgaaccgggagagacggtccagcaaacggcgcgacgggaattgaaagaagagactgggctgacggtgggtgagttaacgctgatcgatgtctatagtgggcccaagatgcactatcagtatcctaacggcgacattattgacagtgtcaccacgttatatcgcgccaatacaacgggtggtgaattgattcaagccaccgatgagacgagtactgcggctttctttgctttagatgctttgccgacaccgttgaccccactgacaaagtggatgctttgcggtgcgtaagcttgaccatgccgatgaggtttgctatagtggactgaaatattaagatgaattgtcaccggacaacgttaacccaacttccttaggtcattgtggaagttgggtggacgttgtcctttttattttgaggaggaattgagaatgacgtggatttatttaattattgctggattatttgaagtggtatgggctacgatgatgaagttaagtaatgggttcagtcactttggctatgctgcggccacagtcgttggcatggtcttgagctttggcttcttagcattagcaaccaaacacttaccgttgagtattgcatatccaatttggaccggtatcggtgcggtcggtgcgataattgttggcctggttttcttcaaagatacaattgcacccatcacgtggatcttcatagcaatgctggtcattggtattattggcatcaaagtcacgagctaggattgggtggttatgttagtgggtttgttggtcgtcagtgaagccgccaacagcttctcaatattcttataaaagaatgattataagcgtgaaagcggtgttataataatcatagaagttaaatgaatatgtggattattcttagacttcttccgacctgagatagacgcactgttgccaagactttacacaattttcctgttacacccggtcaacgcactacctctcggaggggcttcttaatttcgtcagtaattccgtgtatagtcttggttaagtacaacaaatagtgaaagaagtgacgtctgatgatgatgtatccgtatctgaatttaggccccagagatggcgtcttgataattgcagctgctattatgttagctttaacggtagtttttaattggtcagtctgggaacttttgtttgctgttgtggcagtcgtaattgcgttcttagcaggaagcatgaaaccgtctaagaagaacgtgctggcttttttgaaaaaataggttgaattggggtagcaatacttgaattcttcaaatacgtctttaaccagcaaagtttaaggacatcattgataagatagccgagttggttctctgtcaatgaatgttgcgaatcgttctatgggtgcttagccgagcaacggcaagcaccttttttaattcgaacgattcaatagcccatgattaaaatacaaatagaaatctctgtcgccggtaatcacgtatttagttaatgaccaacaacagttatttcagagccaatataaaaacgctcgcgaccagttagtggttgcgagcgttttgtttgatgagcaaaattataagtgttgattgactttcacgtcagctaagtcttgcgcataatcgacgacgcgaatttgatcgccatcgatgtcgatgcgagtgacgctcccgtttttggggccgttcgtgatgtcgatttcaggagcaaaatgtgcgaccatactgcggattgtcgtgccgtgggtaaccacgaggactttttgatggtgatcgtggtgagctttcaagtagtcaaagccctggttgatccgttcccagtacatcgagttgtcttcagcttcatgccaagggtcgatttcacgcatcaggtcgcgagtctgatcgataggcacgtgttcaagaagttcgtgcatgctggtgaccccgtattggcggccaactagtgaccaggtccgacttgaatcgtcaccttcgaaataaccatagaaaacttcccgaaagttcatcagtgttttaaagggctgggcggtggcacccgccgcttgtcgaatgagctgagcggtgtcgattgcccgcttagaatcactactgtagtagtagtcaaaagtcgtgttcgctagtgcttgaccgaccttggttgcggtggcttgtccgtattcggttaacggcgagtcagaccagccttgcatgcgattatataagttgaaaaaagtctgtccgtgtcgaacaaagtaaattgaaaattgagccatgtgtttctccttatttagtcgagatggtctttgcggccaaagtagtctaacgttacatcgttgtcgctaattgtgaatttcgtgacgctcccattttggggccgtgctggtgaggtcagtgcggcaaaacgagcagcaatactgtaaatcgtattgccgtggctgacgaccaaaactttgtccccgtcgtgatggtgagcacgtaacgtatcgagaccgccattgacccgttgccagaattcggcgttattttcggcgcgatggaacgggtcagcttctttacagaaatctttggctttttcgatgccgtattgttcaataattgcggacaaactaggtgcttgatggggcgcaccaaccatgaaccaggtctgcgacgtatcatcaccttcaaaatagccataaaaggcttcacggaaggcagccattggttgaaccgtcaaatcggtattgccactggcaggaagaattaattctgcggtgcgcattgcccgcgtcatgtcactggcgtaaacggcatcgaaatcaataccgttgagcattttacctgcattgcgagcgtcctgttcgccgacagctgtgaggggggaatcacaccagccctgcattcggcggtacttgttaaagtaagtttgaccatgacgaatcatgtaaacggaaaaagttgccattatttactcctctacttggtgttcaaaactaagccataatgtgtttagtttaccataaaatgcactgcgattaattagcagttgctaaggcttgtcgaatctgagcggccgtttgcttattcccggtaaagattaagcggtcaccgtacataatcgtcgtatttccattgggcgcgatcagtttccgattacggatgacttgactaatggtaatatcctgagcaaactgtaagttcttaatttgaacatcagtatagagatggttgaggactcggacttcgtagatgctgttttcagtatcattgagcaatagcaaggttgacggtgattcaattaaggcgcgcagtaaagtaatgttggcctctggtgtattgtagacttcgacgcctagttctcggagttcatcttcatgttcgttgagcacattgcggtcttcaaaccgaacgatgatccgccgtacaccgtatgctttggcggctttagcaagctcgtagttacgctcggcatcaatatggccgagtaccaaaatatccgtgtcaaagacgccgtgatcctgtaagtcctgggctgtgaagttttccattaaggtcactggcacttgcgcgtggtaggtttgataattctcaggatggttcgtgtacattgacacgtcgtaccagccttttcgtagctgttgtgcaacgggtacggtgcttaagttagcgccgataaagtggaccgctgttttgaccaggtcttctttttcagctgaataaaacttgttaaaaatcaggggtgagatgacacaagtgagtagcgctgcgagtaagaaagcgccggactggtcactagtaattgtcttcattgacttggcaactcgaaggacggctaataccattgtcattgtcgttgcagtcagcgcggtaccggctaaagcgttggcttgcttgaaccgtaactttaggacccagtagccgccaatcttggcaaccatgtatgctaagaaaaataatggaattaatagtaaggttttgccacttgttaataaggtccgtaagttcaaatcgacgccagtcgtaatgaagaaaatcgggatgaagaagccgtaaccaatagcatccaagcgttcgcgggtcgtttcactagggttcaagagtttcaagacgattccggccacaaaagcgcccaggatgttttcagcaccgacggattcggccaccgtgaccatcgttacaatcaagaagaaggctaaccgaatatctagttgtgtcgtcgatttgttaatattttgatagaagcggaagaatggtttgaaccgtaagagtaatagtgcggcaacggctaaaatgagtaatagtaaccagagactttgtgagttactgccgtagacggatgcatagagcgtcagtcccatcatcggtacaagttcaccaaagaccgagatgagcagaatcgtttgtccgaaagccttactaagcaattcctgttcttttaaagctgcaattacaataccaagtgaaatcgtgccaaataaaatcgcggcaagccagaaatcactgaagaggccgctgactttaaaagcagcggcgagtaacagcgatagaacaataattgtgctgtaggcgtacaccgaaagtcgaactggcgaatatttcggtgtgttgaccgcgtttttttgttctaaaggtgttaacgccgtgcgccgcttcttaaataagctaaagtcaatttcaagtccacttaagaacagcaggacgatgacgccaatcgttgagagttgtgagataaggtcagaggtgttcacaaagttaaacacgctggggccaattacgataccgacaatgatttccatgacggccgttggcaaactgttgactttgaatttagccatgataagcggaattaataatgcggctaataaaataatgactaaggaaacttgatccatgaataaatacctcgattcgttttagtacacacagagctgatcatcatcaaagccccagaaagcttcgctagcatgtgcatcggtgaaaactttcaggatttggtcgacaccaggggctaatttgtcaggcgtcagttggctcaatggttgccaactaatggccccctcgtatgagccggctagcaaatcaccgtgatagtgactagtggtgtataaggtaccaagcgacacgtcgccgtccacattttcgacccacgtgacggtaccgactaatttcaattgatcgacgtgtaggccagtttcttcgaatacttcacgcttcatcgcagccacttgtgattcaccgcgatcgacatggccaccaggaaaagttaaccccgaccactgggcgtcaatcttgttttcaaccaggacatcgccggtcgctggattggtgatgaggcacatgttgacgagttctgcacggacggtccggtcgtggtgttcatgctgatccttagtggctaaccagtcttgggccttgtcattgatgcttgccatgaatgctgctttcgtttgtaggtaggctgcgagattggcttgcccattgcgcacacctttttcacgaatggcagtatacttgcggccgtctgtccggtgcgcattgagataatcccgaaaagtgagcatttgctgataatgctgttcatcagttgtaatgatcacgtggatgtcgttagcagctaattgtgtcgcgtaagtacgcgtcgttccagcgatcggtcgtgcgtgtaacgtcgctacggcagccgcctgatctttaacaagcaacgccaagtcaattgttggccgcgccaataattgaggcatggccgtactgcccacgtgactactttttaatagattcgcctgtaattgctggcgcaacaaggcttgatactcggttgcttgtgcttgccagtcagattgataggcggttaattgaattggctgcatagaatccctccactcgaataagtcattgaaaggatacactttttgagtggttttgaaaaggaaagacgtgcctttcaagaaattagaacgataatatttaagttgaacggcagttgacacacgactaagaaaacgctatcattgatttatacattaatagtaattaactgggattgtaatagcagtgttcaggagctacacaaaacccgcttagtcgataggctaagtgggctttttttatgggaattttcaagctgaatggagatgagaatgatgcgaattaaaaaggtgctcaataataatgcgtttataacccataatgatgatcatcaagaaatgattgttattggaaaagcaatcgcatatggaaaacatttcaatgatactgttgacgaaagtaagatatacaaaatgtttacgcctgttagtcgaggtgatcggaagctgattttggacatggttaacgaaattccaatccagtattttcaaattgctaaacagattgttgataaggcagagtctgacgaaaatatcgagctgacagatagtgtgtatattgcgctaaccgatcatatttcgtctagtgttgatcgaataaaatccggtttggcgctgactaatcaattcttatgggaaattcgaagttattatccaaaagaatatcagattggacagtgggcgattcaactaatcaatggaacttgtgatgttaccctaccggatgatgaagctggattcattgcgattcatatcattagcggcgaattaggtgaccaattggatgaatttcatgaaattattgatttcgttaagaagattactagtattgtgacctatcaattatcagttgaaattgatcgcgattcgctcgattataatcgcttcgttacacatttaaaattcttttggcaatacatgatggaaaatgataaaaaacacacgattggtgacctgagtgatgaaatgctggcaatcatcaaggggaaaaaggtagcggcttatgaatgtgcattaaaagtgaaagactttgttcagaagacctatcactatacgcttaacaatgaagatttactgtacatgacgattcatatcgcaagaattgcggatgcaaattagggggcagaataatggcatataaagaaatgaacgaccagattattaatggtgtcgggggtaaaagtaatattgagtcagttgtacactgtgcaacaaggctgaggttcgtgctgaaggatgaggccaaggcagatgatgagttggtacggtcgattccaggaattttacaagttgtcaaaaaagcgggacagtaccaattagttatcggaaataacgttgaggatgtttataatgaactttctgatatgttacagctggatgaaaatgtagatcataatcagtctaaggacaagcggagtattttcgacaaaataattagtacgattactggttcaattgcacctgcgattccattgcttgctggtgccgggatggggaaagtattgttgctcattctgacactgtctggattattgactgaaaaaagtcaaacttatcagatgttaaatttgatttttgatactggctatttctttatgccagcatttattggattttccgctgctaagatttttaagacaaaccaatttctaggggcatttatgggattggtcactgttaatccaaattgggttgcaatggtagcagctgggaagcctgttagtttcataggtgttcctatccaattggtttcttattcttcaaccttgattacagctattttatccgtatggttaatgtcttatattgaaaagtttgtaaagaagattacgccaggcatgattaaagtctttgcagagccgatgcttatcatgttgattactgcaccactgacttttattgttcttggaccaattgccaatttgatttcaatgggaattgcaagtataagcatgttcttgtataatcacgccggttttatcgcaattccgctacttgctgccgcatatccatggttagtttctattggtattcataaagcgctcagtccaattagtatccaattagttgcgacacagggatttgatccaataattcgggttgtggctttgtgttcgaacatgtcacaagctgccgcatcattagcagtcggtttgaaaactaaaaataagcagttgagagccttagcactttcatccactgtgacagcatatcttggtggtattaccgaaccagccatgtttggtgtgaatctgaagttaaagaagccgatgtacggtgccatgattggtggggcagttgccggtttgtttgccggatttatgaaaatgaaagcatttatttatgtcactcctggactactcagcttaccaatgtgggtatctaagacagaaaactacgtcgtattggcagtcgctaccattgttattgctagtgtggcaacatttatcgcaacttggttgattggtttcgaagatcctgtcagcgaggaagtcatgaaacaaaagcaggagcaggcgaataaagtggtgacgactaaacattcgattaatagccccgttgttggggaaactcggatgttgaatgaagttaatgatgaaacgtttgcaagtggcgttatgggcaaagggattgctgtcgtcccaactgagggtgtcgtgattgcccccacggatggtgttgcatcagctgtctttgataccagccatgcgattggccttcatttagataatgatgccgatttgttgattcatgtgggaattgataccgttgaattaaaaggccaatattttgaaacattagtaaaaaaaggtgaacgttttcacgcaggtcaagagttattacggtttgatttagacaagataaaacaggctggatatgatccaacggttatgattattgtgttaaatacaaaggactttttagaggtcctaccagtaccagaatcgaacgaatctgtaaccgcagataataatttattaatgttagcgtaagtgaggtaggattgatggatgtttacaaaacgagtcctaactttatgtggggcgtagcaactgctgctaatcaagtagaaggtgcatggaacgaggacggtaaaggcatgtctattgcagattgcctgcgttaccggccgcaaattgatagtagtgactatcaagcggtgaaccaaatggatagtgctgaaattaaaaacgccttaaatgatgaatcgactaaaggttgggcaaaacggcatggtgtggatttttatcatcattatcgagaggatattaaacagttagcagagacaggaatcaatacctatcgattctcgataagttgggcccgtatttttccaaatggtgacgataagtgtcctaatcaagcgggattagacttttacctgtcactagttaaagaattggcaaagtaccaaattacaccagtggtgacgctatcccactacgaaatgccgttaaacttagtgctaaattatgatgcttggtatgatcgacgagtggcagacctttttgggcgttatgcgcgaaccgtcattgattatttacatgattatgttaagtactggataccgattaatgaaattgacagtattattaggcaccccttctcatcagctggattagtcgcagatcgttttgctgatcttgattttaaaacggttgtttatcaggcaatgcatcatcaatttgtggcagcggcagaggttgtcgagtattgtcatcgtcactatccacagatgaaagttggtagcatgattactagaacgatggtttatccatacaatagtgatcccaataatgtgcttgcagcaacgcaaacaatgcgtgaagtgtatgcatttagcgatattcaagtgcgtggagaatatcctgaattcttgttagctaagctgaaaaaagcacatattacgattgaatttcaggaaggtgatcaggaagaactacgtgagaatacggccgattttgtggccttcagttattactcctcaatttgtacggctagtaatgtggaaggtctgcgggtgaccaaagctaatcgaaccgttggcgtttataatcagtacctgcctgagagtgagtggggttggcagattgatccagttggattgagactatctttaatcgatttgttcgatcgctaccaaaagccgttatttattgttgaaaatggcctaggtgctgtggatgagttgagcagtgatcttcgtgttcatgacacatatcgaatcagttacttgcgccagcacattcggcagatgctaatagccatcgcgaatgatggtgtggacttaatggggtactgtatgtggggaaccaccgatatgatatctgcttcgtcaaatcaaatgtcaaagcgttatggtttaatctatgttgacttagatgataatggtgatggctcatataatcgatatttaaaggacagttacttctggtatcaagaattactaagctataagaatcaaattccagcaagttttttagatgaaaatagtatagtcgctcaataagcctagtaaaaaaggtcgcaatctaatttgtggcctttttttactaattctatttataagagatccgctgttgtcgccagcccttaatcagcgcaaccaatgcagctggaatgagcgcggcggccataattcctagaaaacagagcgagaggtggttttgtacgaagctgatcgagccaaagaagtaaccgagtgaacagccgacactgacccagataccaacgccaactaagttccagatagcgaaggtcggttgcggcattttagcggccccggcactcagcgggacaaaggtccgcacgagtggaacaaagcggccaaacatgacagctttcgcgccatacttagcaaaaaattgttgtgcgcgttgttgcttggattgggggaggtggcgttgcaaccacggtaagcgaatcaggtggcggccaatttcgaaattgacagtgtcgccaattacagcagccacaaagaatactggcaccagaatctgaatactgagggcgtcgctgtgagttgcagccatcgtgctggcgagaaagatcaatgattcgccgggaagaaatgggaaaacgaccatgcccgtttcaagaaagataacggcgaataataagatgtaagaccaactaccaagcgtagttaatagtgggacgatactttgttctaaatgggttaaaatggttattaaattgaccaacggcgccacctccagtttaagttgcatttattataagcgtctgcgggttgaaaaacagatgtaaccgattacattcttttcagtttaacacaatcgtaactttgatagaccaatgttcaaacaaatttacataaaaaatcaaaaactggcggctgctatgggttattaattgagtcgggccgccgatagtgataaaattattgttcgatatttaggaatggagggcgttcaatggctaagtcaattaaagctgcagaacaggaacacttagatcatgtggttgcgaaaattaaggtggctgaagagcaacaaagccaaaccattacgcgctcggaaaaagatcaggccgatattaaacgtgacttgctgaataacatcaatataaaaacggatagttacgaaggcatgatggagaccggattatccgtgcggcagcaacaacagatgatggatgagcggcagaatagttggaagcacgcgactaagcaattatcgacgttaaaaaagttggaaaagaatgcttattttgcgcggatcgattttcatgagactggtgagcctaagcctgagacgatttatatcggactcagttcattttctgacacgccggatcactttttgatctacgactggcgagcgcctatttccagtatttattatgacggtgggttagggcacgtgacgtaccagactccggatggtgagcagaccgttaatgtgaagttgaagcggcagttgatggttgagaatggccagatcgtgacagtctacgatactgatgaagccgttggtgactcgatgttactagaagtgttggatgaaaagtccgatgtgaagatgaagagtatcgtgacgacgattcaaaaggaacaaaataccattattcgggatacgagttctgacctcctgtttgtgcagggggcggccggttccgggaagacctcgtccgttttacaacgggtcgcatacttgttgtatcgttaccggggtaatttgacggccggacaagtcatcttgttctcaccaaatcaactctttaatgattatattaaccaagtattgcccgaactgggtgaacaaaacatggttcagatgacttatttccaatacgcatcgtaccggttaccacacatgcaagttgaaactttacagcagcggtttgaaactgaaaatacaccgcagatggcaaaggttacgaagttggaaggtagccttgcattcttcaacgcggttaccacgtatggccgacatttggaacaagcggacatgcgtttccgtaacattacgttgaacgatgaagtgattatttcccgggaaaagattaaatcgatttactactctttcaacgaaaactaccacttagcgaaccggttatcagcaactaaggaagaattaatcaagattttgaatcgcaaggttgaatcggagatgcgttccaagtgggtcgaagaagcggttcaagacttatcacgcgaagagatcaatcaattatatggcaatcagccgcgggaatttaagaatggcgataaagagtttaaattcttagcacgtaaaattgtgatgcaacgcttaggaaaagcccggacgcaaatcgtgcgtaaccgtttcttgagcatcaacatacagtacgcgcatttcttacgcgaagtaccgaagatcatcaagttggctgatcacggtatctcagctgctgactgggatgctacggttgaacggaagttggctgaaattaaggaccggcatatttctttaacgaccgtttcggcctatatgtatctgcatgatttgatgacggggaaacatggacaacgcgacattcggtttgtctttctggatgagattcaagattacaacgcctttcagctagcgttcctgaagtttagcttccctcaagcccgcttcacaatgctcggtgacttgaaccaggcgatttttaccaaggaaaacagccattcgctgatcaatgaattggccacgttatttgaccctgaaaagacgcgggtcgtgcaattgactaaatcgtaccggtcaacacaacagattactgatttcaccaaggaaattttagtcaatggtgaagccgtcacggcttttgatcgtcagggcgacttgccaaatgtcgttgtgacgcctaactttgaagcaggggttgatcaagtcgttgatcagctagcgatgaacgattctgaacgtgatacgacggcaattatcgggaaatccttagcagaatgcgaggcgctcacgaaggccctgaaagctcgtggtgagcaggtcacgttgattcaaactgaaaatcaacgcttggctcctggtgtcattgtcgtcccgtctttcttagcaaaagggttggagtttgacgcggtcatcgtgtggaacgctaatcaggaaaattaccaacgtgaagatgaacggcaactattatatacaatctgttcacgggccatgcacgagttaacgttagtcgcggtgggtagcttgtcaccgttactagcgcgggtgaaccacgccttgtatacattaaatgaagcaaaagtttaagtcagtttaagacagtgagtaccgctccattcacctggagtggtatttttttagttttacttgtgaaggaaatcttaaggtgtgtcaggatgatcagtggtggaacagttggggaattgtgtcggaatagctgaggaaacgctatcatagtgatggaataagcgttaaaattaactcatcaagtgcagtagtctgtgagagacaatggccttaatactgactaggcacacaatatcgtgaaaatactaacaactagttagaacggttgttagtgacctgaggaggaaacgacgatgtcaatcactgaaatgttaggtattcaatatcccattttttctggtgccatgatgcgaattgcgacccatgaattagtcggggcggtttcggaagccgggggactcggtgttttaggttcagcggggttatctgccgaacagttgcgagcagagatccaagcaacccgcaagctgacggataagccgtttggtgtcaatttaatgttacagatgaagaactgtccagaactggcccaagtcatcattgatgagggggtcaaggtcgtgacgactggtgcgggtaacccgacttcatatattccgccgctacacgcggccggtattaaagtgattccagtgattgcttcggtccaccatgcccataagatggtggcggccggtgcggatgcggtggttgctgaaggtcaagaatcaggcggacatatcggtcaaacgtcaacgatggcattattacctcaagtcgtggacgctgttgatattccggtgattggtgctggcggtgtcggtgatggccgctcgattgcggcgatgtttgcgctgggcgcccagggtgtgcagtgcggtacgatctttctgacagctgaggagtgcccagttccagctagttataagcaacgggtattggctgccagtgacacggatacaatcgtgactggccgcagccagcgcgatccggtacgggcgctagttaacccgatgttggcacaatacttgcaattggagcaaactaacgcgccggtagcggaattacacgcgttagcggacggttcatttgcgaaagccgttgaagatggcgatatggaacatggtacgcctatggccggtgaagtggcggggatgatgacgacaattcggccagtcaaggaaattattacgacgttgtttggtcaggctcgtgaggtcgcggcacaactgaaaatcgaataagatacagtagcatagctcggtactaggtcagcgttaactagtatcgagctattaatggttattggctaccaattaggaatccggttaatttgaattttaatcagcgtttgataagggtttcatgttataatcaacccattaatttagtaatggtggcagacagaaatcatggaagatcagatgaactattatcgcttctcacgtgaacagtggaagcaattttatcgtaacaatcagcatcaagtaccattgaccgcagccaatttgcacgaaattgaggcgtttaatgaccggattagtctcgacgatgtccgtgatatttatatgccgtttgcgcatttgttgcaggccaagtatgaacactacttgtcatggcgggaaacggagtccgtttttttacaccgtcagaaccgccaatccccctttattattggagtgtccggaagtgtggcagttggcaagaccaccacagcacggttgttagagattctatttaaatatttatatccagaccggcggacgcaattgattacgacggatggtttcttatacccgaatgccgagctcaaaaagatgcaattgatggaacgtaaagggtttccggaaagctatgatatgacgcggctgatccaattcttgaacgatgtgaagagcggaaagccattagcgaaggccccggtatactctcatcagacttatgatattgtgccaaaccgctttgacgtgatcacgcatcctgacattttgattattgaaggaatcaacgtgttgcaattgccaagcaatcaggcgatctacattagtgattttacggacttctcagtgtatgtggatgcggatgccgatttaattgaagattggtacttagaacgcttcaaggccctgatgaaaacggctttccaggatccgacgaattatttctatccttgggcgatcggtgatccgaaggacgcaatggcgatggccgagcgtgtttgggaagaggttaacttgaaaaacttgaatgattatatcttgccaacccgtaatcgtgcggatttaattttgcacaaagttgcgcatcatgtgattgatgccgtgtatttccgcaaatattagcacctaagaaatttctcatactggttgaccgaacgtttagaaatcagtatgatagacctattgagcattaattaatccaaaggagtgaacaacttggcaaaaacggataccgcgtctttcgattccattttggtattggatttcggtagtcagtataatcaattgattacccggcgcattcgtgatttcggcgtttattcggaactacttccgaacacgatcaccgctgaagaaatcaaggcccgtcacccgaaaggtattatcttttctggtggccccaacagtgtttacgatgatggcgcctttcgggttgacccggagattttcaagttgggcttaccaatcttggggatttgttacggcatgcaactgatgacctacacgcttgcgggcgggaaggtcgaatcagctgataaccgtgaatacggtaaggcgaacattgacgtgacgagtgactcggcgaccctatttaaggacacgccagctgaacagtcagtgtggatgagtcatggtgacttggttactcaagcacctgatggttttgacgtggtggccacttctaagaactgcccgattgcagcaattcaagatgttgaccggaagttatatgggattcaattccatgctgaagttcggaatacggactacggtaatgatattctacggcactttgcatttgacgtttgccaagctgaagctaactggtcaatggatgacttcattgatatgcagattgaaaagatccgcgctgaagttggcgataaaaaggtcttactgggactttccggtggggttgattccagtgtcgtcggtgtgttattgcacaaggccattggcacgcaattaaccagtattttcgttgaccacggtttgctacggaagggcgaagctgatcaagttatggcgagcctggaaggtaagttcggcttgaacatcattaaagttgatgctaaggaccgtttcttaagcaagttggctggtgtcagtgatcctgaacggaaacgtaagatcattggtaacgaatttatccaagtgtttgatgaagaagccacaaagttaaacgggatggaattcctcgcacaggggaccctctataccgatgtgattgaaagtgggacttcaacggcccaaacaatcaagtcgcatcataacgttggtggcttgccagaagacatgcagttcaagttgattgaaccgctacggacgttattcaaggacgaagcacgggaactcggtgaaaagctagggatgccgtctgaccttgtttggcgtcaaccattcccaggtcctggtctcggaattcgggttattggtgagattacggaagataagttagaaatcgtgcgcgatagtgactttatcttacgtgatgaaatcaaaaaagccggcttagaccgtgatatctggcaatacttcaccgtattaccaggcatcaagtcagtcggtgtcatgggtgacggccggacctacgattacaccgttggtattcgggccgtaacatcaatcgacggtatgaccgccgactttgcacgtattccatgggatgtcttacaaaagatctcagtgcggatcgtcaatgaagtcgatcacgttaaccgcatcgtgtacgatgttacgagtaagccaccttcgacaattgaatgggaataggatttattgaaattaaacaacttctatcccattagaacgagattcgtaaggatttcaaagttgaacaaagctgataaatttaaagaaaatcactaaaaaagtggtaccgaaatggtaccactttttttattttgaatagcatatggtacaaaataaaaaatcgtattgaaagctatcgaagataaaagatactccgtttacgagagtatatgttagggcagtcggacaagtatcaatatcagtgtgtactggtttaactagtcgatttctatcgttaacacatgcgttcttttagggctgatattactaactgattgcagatcagactatgcttgtggttgactaaaatgctttaatgaagctaaatataaagatccaccaataattgcgagaattccgccaatccaacctaagaatggaataagcgcgattgcgccgccgacaattagtaaaacgcctgatgcagtaccgacacgcttatcacctttataataaattaatgcaataattcctaatgctaaaatagcaattttcaaaatgtttaggaaagcggccgcacctgatgtattagatactgatccagtggcagcatcgcttagaatgcccccagcaataaaccagcccccgaataataaaataatgccgccgactagccctacaatcccgttagtaagtgctaaattttttgtcttcatgttgaagctcctccctttattaacagcttttcgtgtcgatcagtttattggacataagttgttgaagcctacccaaaccattaatccccgtattgataggtttatttttcgtattcaaccttgaaactagtcttttattattaaaatctatcagtcaacacacttatgtttgcggcataaacattaccttagtgtcaataatgccatactgatttcgcatcacttgctcgattctttcactgagctgaaagctggctgccactgtcattcgtggtgacactgctataaccagcgacaaggccactaagctcccagaatactggacatcaattgcattgacctgattcacaccatcaatttgttgaatcgtattaatataatttttttcaacttgtggatcactgtaattaattagctgcaacccactgtcccgaaaaatttgtaacccagcggcaaaaataaagaatccaatcacgatactcgcaacactatctaaccaagcaaatttgaatagtaagaccccacttaatgagattaaagtgccaatgctcgttaacgcatcactaagactatcctttgccgcagccaatagcgtcgaattatctaattgttgcccaccgcgacgattaaagtaccagacgactaacataacgatgctcgcgattgcagctccccaaacagttacaccgctcactgcttgaacggtgtgtgatttaaacaaattactaacaccactcacaataacttgtaccgccataactaacataatgaccccactcattaacgtgaataagtcttgtaaacgaaatcgcatcaatcgattgcgacgttcggcctcccagccgtccaaagcggtcactttactttgatgtggttgatgattatgaatgccaccccagataccaagcgataacaaccccgatgaaacaatacccgcaaaattattaaacgcatccgcgtgcaaagattgcgaatgaccaatcattgcaagcactagttcgattacaaatagacttaaatatgctatcgcattgcccaacagatgccacaacgcaccctgcattcgcttaatttggtcagcttcaatttcttgccagccatctgacacgggatgttgattatttgattgattaatcgtaatcgccccctcttaaacagattccaaccgctcactctaacacttagtcgtaataagtcaaccttataccacctagaatgctgatagcttaacactaacagtctgacttgtaattgtcactatcagcatctttaagcagtaattaattaaagctggcaccttcgaaagtaatccacttcgaagataccagcttacaattatccttgataacctttacgcgcagtcacaagctactgttcatataaatcacccgaccccatacaaagcctgctaccggtaaagtacagttacaatcacactaaggttcacgtttcgctatttgagacgtcacgcgtcgcggctcagaattctgcacacccaaaatatctaggaagaatgaaacaattggaatcccaatgatcaagccccaggcccctaatagactttccataataatcaacgtaataaaagtgacaaagactggtaaatcagtccggtccgccattagccgtggatgaaggaaataagactcgaaggcgtgaatcaaaacaactaacacgatgatccagacaacccgaatcaagccacccgacgcaaaccccagtaaggttagcggaatcattgaaatcaacacgccagccaccggcactaagcctaagataaagacaatgatcgacaacaccatgatacttggcatcccaataatcatgaatccaatcgtcatcaaaatcgtattgatcgtacaaatcaccagttgcgtttcaataatccgccccagaatcataacgaatttatgcgttaaatagtaaacgttcgtgaagaactttttaaacttcgactgcaagaactggcggccaaagaccatcattcgtccccgcgaaactgcaaagataaaactcaaaaagattgccattaagacgtgcgtaaagccagtcccaacctcactcagtcctttaataccggtgacgagtaacgccttcccgttttgaatcaattcactactatgaatggcttggttgacccatttatcaatattcttattcaataccgggtgattggtgattgctttagccagcatatctggaatgaccttcaactgatcgaccagggtaggcgccgcgtacgatagcgcaccgataaacaacgcaatcacgccgacgtagaccacaatgacggcaatccaataaggtaagtgcgttcggaggtttaaccaccgactaagcttaatgcccaaatacgcaaaaatcgtcgttaatagaacaactgtcgcaaacccgcgcattaaataaataatgatgattaataacgccaacgttaagtacaagtcaacgtcatcccgcttaaaaaaccgaatgattctatccataatttgcccccaatcgcatgttacttgcattatagcatgactatggattaatcccgcccaccgattccggccttaaattaaatttgacatttaaaataattaccagtatgataggtgtcaataattaaagaacgattaaaagatgagtaattggtgtcgctgttcagcgagtatcgggttggtgaaacggtatcggcacaaccaatgaagatggtcttctccctagttcgttttggtgagtgtctggtgagcaacaaagtaaccagcattaactaaagccggtttaacaaccgttacccgcgttagcaattgccaatcaattggcagctgtatcgagtagactagttcactagcctagaactcaggtggtaccacggcccaacgtcgtcctgaataatgattaatattattcaggacgacgttttttcgttcccaataaaatttaaggagtttgatatttaatgacaactacaactttaaccgccccattccgttttgacgtcgtcggcagcctattgcgccccgctagtttgaaaaaggcccatgaacaattagccgccggtaccattacgcgtgatcaagaacttgaaatccaacacactgaaatcaaacgagtggtcgctgaacaagttaagctcgggctcaaagccgtgaccgatggcgaattttcacgcagctggtggcacttagattttctttggggcttaactggtgttggcaagtacgactaccatcaaagctataagttcaagggggaccatactcgaacggataacgctgaacttattggcaaagtcgcgtataatcccgaccatccgttctttgctgcctttgaatacttacaatcaatcgttcccgctggcgtactcgctaaacaaacgattccatcaccaactatgttattccgtgataatcggagtgacaattggaccaaattctatgacagctgggatgcctatttaaatgatctcgcccaagcttatcacgataccattcaacatttttatgaccttgggtgtcgttatattcagttagacgatacgacgtgggctttcttaattagcaaactcaatgatcccgaagctgaccacgcggcctacactaagtgggcgaccgatgccgttacagtgatcaacgcagccttagctgacctaccaagcgacttgaccgtcacgacccacatctgccggggtaactttaaatccacgtacctcttctcgggcagttacgacgtggttgcaccctaccttggccagcttaactatgatgggctgttcttggaatatgataacgaacgggcgggtggcttcgaagcgttagaccagatttggaaccatgatgaccacaaacgcatcgtattaggtctggttacctctaagtttccagaattggaaaagaccactgtgatcaaagaacgagttcaagctgcgaccactaaggtgccattgcgtaatctagcactatcgacccaatgtggctttgcttcaactgaagaaggtaaccagttaactgaggctcaacagtgggccaagttggcgttagtcattggtacggctaaggaagtctggtcagaagcctaattacaacaactaaaaaagctcgagaatcaaacggcgcatttcaagcgtaatcgcttaaaacatcagccagattctcgatctttttagttaccggttaaaccgggtccgccaccgtgccaagcgcggcgtcgctgtagccggtttagtcgctttagcaggcatgttcaatagaatcacacccgtaataatcgccatgaatcccaacgttttcaatcccgtcaagatttcgccaaacgcccaaattccaatcaggccggtcgcagctgtgccgactccggcccagattgcataaccaacactcagtgggattttgctcaatgcccgtgagaaactaaaaatcgctaggccgtatagtaacatgcccacaattccaaccaaggggtacttaaatccagccgataacttcaacaagctggtccccgcaatttcaacgccaatcgcaataactaattgaatccatgcacgcatcatcattcccccttgatttaaatgttcagtaaaatcgccccgactacgattgcaattaagccactcagacgtgagagactgagccgttcacggtaaacgacgaccgctaaaataacggttgcaaacgtgcccagtccagcccacatggcatacgtcacccctaacggcaggcgttgcattgcaagcgttacaaggactaacgaactaaaatatccaaccaacaccattatcgttggtattaagttccgaaaaccgtttgcgcgctttaagaaaaagctccctaaaacttccatgaaaatgccaccaaataataacccgtatgccatcttaatcacctcactaaaaatttcgttgtcctactattctacggaagtttatttaaaaaggcaatcaaaagatacgcctggctgattacagtttgatgacaaaaataaatcgtattctagactatgctacagcgatctagccatttaatttcaaaattattgttagctgagtggcgataactcattcagcttaacgagcgtacgcaatggttacgattcgaataccgtccagttgaaaaacttttcgcaataaaatgtcaataatcagcatttaagacgtcgtccgcgattcaaatctcccgcatctaaaaaaaaggatcagctcagcagctggtccccacagtcatccttaaatatagaaataaattgagaaaaacatcaacgtggttcccaccatcacgaataggtgccaaataacgtgtaaatatttaatccgtgggaaactatatagtaatgcacctaaggtaaacgcaacgcccccggcaactaataaccagaagccagtgacacctaaatggtcccataactgccgaccaccggcgaggcacatccaccccatcaacacataaatgaccgtctcgacctttttcaaacgtccgggccaaacagcattaaccgtaatcccagcaatcgctaaaatccaaatcgttaataagatcgtccagcccaaccaacccttaatcgccagtagactgtacggcgtgtatgtcccagcaatcagcacgtacacgccactgtgatcgaagatacgaaaaacttcgcgggcgcgcgtaaagtataatccgtgaaataacgtcgaacacgtatatagtacaaacaacgaacaaccatatataataaacgccgcccattcgaggggctgaccatccgcatatgccttgagcatcaaaaaaacaaatgcaacgatacttaaaataatcccaatcccatgagtcactgagttgaggacttcatttgttatttgatactgtcgcgccgactgtgccatgttaatcacctcatatttattattgacaccagcataccatcacatagtgtaaatatcaatacatctagtttataaaactaggtaattaacaaaaacataactagttcaaaaaatgacactgcgaaattaaccatttcgcggtgtcatgctaagcacaatcttatattcaagctaatcgtgcggtcctctaggccatggatatctataccagtgcccactacgaacccacagcgcttaccactcatcataactgatcagcggtaacacctattcaacctaattatcggcttcttcagcgtgagctgcgacctgctgaaaaatactaatgatatgtttatcggccagctggtagtgcacgttacgcccattgcgcgttcccacaactaattttaattgtttgaggaccgttaactgatgagacacattcgactgtgtcagggctaatcccgtcgccagttcacccacactcagcttagatacggccaacgcgtagataatccgggcacgcgtcggatcaccaagtgccttaaagattgcggtgatccgactcaactcatcagtcggcggcatcagttcagccaaccgtttgacgatcatttcatggtccatttcattttccatcataaactccaatttctaattgagattgtcatgtaagcgtgttacaatacacatgaacagtcattcatatgtttgctcattcatatttaaattatagccataacaaggataaattcaactaagaagtaggtgattcatatggcacacagccatcaaatacaacaacagaccagcgccttcaagattggggtcgccctaaatactgccttcattgtcttggaagctggctacggttttgcgagcggctcactggccctagttgccgatgcaggacacaatctcagcgacgtcctgggcttactgatctcctggctggcaatctggcttggacaaaaaagcgccaacgataagtacacatatgggtacaaaagctcatcaatcttggccgccctcttcaacgccgtctttttactagtcgctatcggggccatttcagtcgaggccatccagcgccttagtaatccgggtcccgtcgccgaatgggatgtcattatcgttgctgctgttgggggcgtcattaatggctttaccgcattactctttatgaagggccaaaagcacgatctcaatattaagggcgcttttctccacatggccgccgacgccggcgtctccatcggcgtggtcattgctggcttcatcatcttgaagactggctggttctggctagaccccgttgtttccctgctaattgccgtcgtgattttgattggtacttggggactcttacgagatgcgatgaattattcactagaagctgtaccgaacaatgttgaccgccaagcaatcgctgattatttaaccagccagcccaccgtcaaccagattcacgatttacacatttggggcatgagtactactgaaacagccatgaccgtccatctctgtcgttcaacattagctgacaataatgcctttttggaacaactgaacaaggacctaagcgcccagtttccactaactcatatcacgattcagattgaacttggcaaggtggattatgaaacaacggatagttcgatttagttcatcgtgagttaagttatgatacacagcatccaaatcgaatctgtttctgtataaactatctcttccgccttaaacgaccgcatgctattaagcatgcggtcgttttttgtcttacacattttcgttagtttgagacgccacggctcacttccaaactcatcaatattgactagctcggtaaactacgaccgttctcgttgttttggcttcaaaaagatagctaataccaaacttaatatcagtattgatgtgaccagcaagcgaccggccacttcaccaattatcgcagcggggccatcatcaacggcatgtgctaactcgttcagataactcggtactattgtattgatcagaatctcagcaataaatgcaataaacaccgtgatgacgataccgacacgcaatttacctgacttgaaccgctgccaatctgaaaaatacgacaataataccatggcgttcaccagtactaaaaacggtaccaaaaacgttcgtattccaaacggccgcaaatagtcaatgtagccaagtaccagtaacaagaaattgcatcgatacgagacgaccacccattttcggctcttctgatgaagtcgttctgcttccttataataagccagtaagtgatcatcccgcattaaatcgtctagccgaacgtcataaatatcactcaattgaactaaactgccaacatcgggaaaactgtggtcattttcccagcctgagattgttttgcgcgatacatgtaattgttcggccacttgcgattgtgtcaattgtgcgtgcttcctacacacttttagtttttcagagaatttcatatcagactttcgactactccctcatactttggttgccataacgcgattaaaaatcatgcttttttaccatgacctgatcaaaatgcacgttcattcgcacgcggctcacctttcttaaaaaacaacacttgaattaaaaagccaatagcaacaattacaaaaacaagattaatcagatttgtgccatttcgccaaaattcgcgacctaagacattaccgttaacaattgctggataaacgttagcgcttagcaatagtaaaacgattgcagcccagaatctgtagtatttgtagaaaacaaaattaatcataaccaatcactcctaaatgtcttacttatatttgcaatttataataggtgtcttatcagataaatacaaccttcttaagtaaaaaaactagtctgtattttccagacatgcaattaacccgctcatgctgggcatttagcacagtataaccatcagtctgatgcagtgagcatgatttttgtggataacgcttattcattcaaaatctatgcgccaaacgctataccgtttgctgaaacgttatggtactagaagtagttatcactaaccagtatccgagttagtcacactacgatgctaattaccagtcacaggttcaacgataccgcaacctcagcggtatcgttttttcaaatattcagcattttttgacgttcgtacgttaaattaagacattaacgcacattgcagcacacataacgtcattcattatataatttaagtaatatttattaattcagataatctggttcacttcattcttagctaaccacctaggaggcacttacatgagcatcatcaatcgcgttatcggtatcattatcacgcttatcttgttatgccaatggttgcttggctatcaattaccagctgccatggcgttcttcttagtggcctggctgattggcttggtaacgatgtggctgttgccagactcgacgaccgctaaccgctagtcgtgtcagagggatacaaaatcaactcattctaaaacacgtcacaaggccattaaaacttgctcttgcgacgtgtttttgctaacttcactattacttagaaaacggttagactggttctacacgccagcatcaccgaccattcaaatatgtttttgccgcttaccctcattgtgaacttgcgtttcatattgcgatggaactaataatcacacttcccataactactccggattaaagcaccccccttgcttacattcacacattgatactcacaaagatacacaggcataagcacataaaaaaaggccagcatccgccagcctaattctacctaattcaatttaatcaatcccgccgccaacaaaaacatgtgggtgacgactggtccaacgaatgtcaaaccatgtcggtgtaaatccttcgcaacgcgggcgccaaggggtgagcgcgtcggtaattcatcatcgggcgccggcataatgattggtgtcgcatcgacaaacgcccacaggtagttgctaaagctaccatactcggcctgtaattgttgaatagcacgcgcatcctgaatgattgcacgtaacttacgaccattgtgcatcactttgggagtcaacatcagccgttcaaaatccggttcgtccagggcggctacggcgtccacccgcagccccgccatatgttgccgcaatactggtaactgactagccgcgacccgccagcctaaacccacttgtaagattccaaccactaacaattcaaataaaacgtgatcatcgtacgtgggagtaccgaagtaagcatcgtagtccttaaccccattcgccgtaatatcgtcaagatcatccggactaatcattattcgataaccaatagccattctcaattcggcctaacagcgtaatcaattgcttggtttcagcaacatcgtggacccggatgatccgaccacccttaagcatcatcgctgcttcagtgaccaacgtcattggtaatcggtcttccttcttcaggccaagcaatagacctaaataacctttccgtgaaatagccaccatcattgggcgtcgcaagtaattaaattcatcaatgttacgcatcatcacgtaatcctgttccccatgtgcgacttgtgaatagccaatcccctgatctaaagcaattcgttcaatatcgatgccatgactcgtcaatgctgacagattttgttcaaagaaaccacgcatactgctcgtcagatcggtatattcttggtcacgactactgtgcatcgtcagtaagccgacgcgactgtcagccatcaatttgagcttgcgagggtcgtccgtaaaggcgttcacatcgttaataatgctgacaccttcttccaggacggcttgcatgacatcatacttataagtatcaaccgctaagactgcttccgggaaacgagccttgatggcgcgaatgtacggcaacgtccggtctaattcaacttgcggcgtgacttccgtgaaccccggccgtgtcgtttgaccattaacttcgattacgtcagctcctgcttgtaacatggcatccacgtgattcagtacgtcatctttagtcttgtactggccaccgtcgaaaaaggaatccggcgtaatattcatgatgccataaatcatcggcttcttggtgagattaaaccggtgctcacccgcttgccaaaaaacatcatattgtttcataatttgagtcaattgaatttgagtcgttgcttgatccgtaaagactcgcgaccattggtgggttaactggcgaccagctgtctggttcagcaagacggtcaactgttcaggactcgcctgcacgaccccatctaattgctgacatagttgggttaatcggagttgctgctctcgattataatcactaaaacgcaaaactaattgttgttgtcgttgaacttgggcattcaacgcctgactcgcaaaatccgttgcttgtgctaatgaactggtgatatcttgtactaacatctactccaccgatccttccaatttttaaagttttgtgattaattttaaggcggcccgtccccggtgtgtcagcgggatgcgccacgttgctggtaattcggccaaagtccgaccatagcgcggtagccagaaaattcggtcaaatccaccagaatagcgtccaaattgataggacgctatgtagccggtgatcgaagcttgtacggccaaggtccgcccatctggccaggcagccgctaacgtagcgcgcatcaccgcttgccgctcgttgttaggaatatcgcgtagggccgttaaaatttcctgattgcgatcaaagccactgactgcaacccctaagtcgcgcgccgtggtcacacctaacaagtctggtaacgcggaaatctctaagccactatcatctgcgataaccggaacccctagctgttgcgccccaaaacgagctttagcaaccgcgttatcgacatagctcgtcgtcgtttccacgggaaattcgagccgcggcgccactgtcaagtactgacgagcagtcaagccatagtaagccaaacacgtgatcaagtcgcggcttttaccagcgttgttggatgcaatcaaccaagtcgtcgtcattggcttaaccccggccaaccagcctgttggagctcacgaatgacataaaatgaccccgttacaataatcgcactattactggttgcttgctgctgagcttgcgttaacgcatccgtgattgtcgttgcaatcaataagtctggctgtcgttgcatcgcagccgtggtcataaaggtgggcgttaataatgcggtcgccatgtcggccagcttagtcgcggataacgctcgttctggatttgcgggcgtattcgtaatcaggacgtcagctaccggtaatagttcagccagcattttagggtaggccttatcttgtaagaccccgacgatccaaatcaatttacgaccagcgagtaattgcttcacacttgccactagtgctgccatgccatccggattatgcgccccatcggcaataatgacaggttgctcctgtaacacggtcaaccggcctggcaaggaaacttgttgcaagcctcggcgaaccgcactgttcgtcaagttaacttgttgctgttgtagtactgcaaccacagttaaaaccaaccgcagattttgtagctgataggtgccactcagtccgaccgttaattgcgtccaatcaaaaagctgactgtgcgcatcaacgacggtttgcgtgagtgtttgcccagtcaccgtcagttgcacgtgcttagcggtcactagccgaacaccttgattgagcgcttcggtctgcaaaacagccagggcttctgggtgttggtcagccaatgtcactgctgttgtatggggcttgatgatttttgacttattttgcgcaatcgcggtaatcgtgggcccaagaatggcggtatgatcgagggcaatcttagtaaataccgtgagttggggactggctaaggcgttagtcgcatcatacaagccgcccaaaccggcttcaatgaccgcccattgcacgttttgattccgaaaccaaacgacactaatgagaaagaaccattcaaagatggagacatcgctagctgtcagtcccatattttgcagaaccggtagaatctcacgatacgtatcgataaattccgctggactgatccacgtcccattgcattgcagttgttcacgcgcatcattaatcgcggggctgctgaagcggccaacttgatacccttgcgcccgcaggatactggctaacatagctcccgtagagcctttgccattagtcccagcgatatggatcacatggtaataatggtcagggtgaccaagatgtgccatgattcgccgtaataacggaacacgctgatgattattggctagcatggcttgatttagttgggctaataagtcctgatagcgttgttcaatcgtccctgtattcactcaatcacctactttgcgattcgctgtaagaattctcgtttcaagtctaaatccgtcttgaattgaccactgtaatagctactttccgtatgcacacccggtttgctaacaccccgcatctccatgcacatgtgccgcgccgtgattgagaccgcgatcccagccgggtcaagaattcgttgtaattctgttgcaatggaaactgtcaaccgctcctgaacgttcggctgttgactgcaatagtcaatcaagcgaggaatcttactcaagccaatcacttgttcatgctgcggcacataagcaacttgaaccgtgccaaaaaacggcaaaaggtgatgctcacacatcgaatagaatggaatatccttaagtaataccatttcagtcggatgctcaaccttgaacagtttataattatcaaatggtgcggcggtcttagtagcgaaaacctccgcatacattcgtgcaacccgtgctggggtttctactaatcccggtcggtcaggatcttcaccaactgcacttaaaatctctcgtaccgcatgctcaatctttgcttggttcttctcatcaatcatctaactcactcacatttcttacttttttaatccaactctgatcctgattggccgcaatcaattgggccacttgtggtccaactagcacatcagttttggcgatttcagcggttggcagcaacacaaagttgcgcttagctgcccgcgcatgcggaatcgtcagcgtcgctgtgttgatttgccgatcgccccaaaaaataatatccaaatcaatcgtacgtggtccccagtgaaccaagcgttggcggtggcccgcctgctcaattgtatgtaattcatccaatagttcttctggtgtcaaattagtcgttaaggataccgaaacattgtaaaagttggcctgatcacgctttccccacggttgagtctcataccaatgagattcgtcaatcacgtttaccccattgacggctcgtaatcggctaagggcttgctgaatattttggacgcgcggatgaatattggaaccaacactcaaataaacccgttcttccctacttgccattcggcgtcccctccacctcaatttccacatcatcaaagattccaggcattggtacgctatatttacgaattttaatattgattgcatccgccgcgggaaaacttgtcaataacgtctgcaataagtggttagctagcgattcaatcaacttgtatgaatgggtcgttacaaattcatcgaccacgttacggaccgccgcgtaattgatggtctcgtgaacgtcatcgtgttgaaccttggtttcgataggatatttaatggcaatatctagccctagttgttgaccattacgccgttcttccggaagtaccccgttaaacgtgtgaaagcgtaaattattaattcgaatcatgcccataagtatcccagcctctttcttgctcatttttacttataatcatagcatgaaggacgctcaatatgatagtaatcagccaaataaccccataaaaactagcaatcgttcgggaaccgaaaaaagtgcgttgctaacaaaccggttcatcaaaaaagacgttgctggtcaaaaaaccagtaacgcctttgtcttagtttaaagcagtcgtacccccaccatgaactctaggaatccgtagtcgtcccatcattaaaattaatcaaattactgaggtaatggctagttagaccaggtgtctgcttcacaatataggtggcgagcggtgactgcgtcatttgcgtctgaataaagctcgtattgacgatgttcgccaacgacaacgcgacaaaaataaccagatacgtcacgacaaacgacacgattccacccgcaacactgttcacttgcttaataactggtagccacgtaatgctacgtgaaacgcggcctaacaaccgaatcactgaccaacctaacgaaattaacacgaagaaagcgaccaggttaatgatcaacgttgccgccactgaagcttcaattaaatgtaaattcgtcaatagattactaatcattgtccctaacggctgatagagtagtcgtgcaaacaataggacgacgaccgtcccaatcagatgcaacatttcaatcacaaatccgcggtgaaacccgcgaaaaattgcgcttgctagtaaaattaaaatcacaatcgtaaatatcatctgcgtgccccgccttccgcttttcaggtacgcctattttaccagctttcgtcagtcagtgcagtgttttcacctagtctaaaccttatcttaaagacttgacgacgaccgtttctttcggtaaagttaacagtaatggttacgatttaaagagaatggggttacaatacatggtcaaccgacggatatggctttatttggcaataatactgggactcagcggcctattagcaggctgtcaaagttcgagcacccccagtaaaacgactaacgacaaaattaatatcatggctagtctcgacttttatggtcaaacggctaaggcggtggcaggaaagtatggtcaagtgacctcgattattgatcgaccgagcgttgacccccacgactacgagccgaccgtcaacacggctaagcaggctagtagcgcccaattaatcatttacaacggcctcggctacgatgactggatggaaaagcttactgtcaacaaagccaagggcgcccgggtaatcacagtgggaaccgacgtggctcataaaactgacggggccaacgaacacgtctggtacgatcccacaacgatgtccaagctggcaacaaaaatcgcagcagacctcagcaagattcagccacaacacaagcactatttcgaacaacaagcacaacagtatcaagctaacgctaagacgatgaccactatgatcaaacaattgaaacaacgtgcaaacaatcagcgcgtcgctgtcagtgagccggtctttgactactcattggaggcaatcggctaccgaatcagcaatacgcatttcgcacatgcaattgaagagggttccgacccatcacctaaggatatccagcaaatgcaacaagacatcaagcaccaccggattgcctttttcgttgaaaacactcagaccgatagtaacttggtcacgaacatggtcaaactcgccaggaaatacgatgtgccagtactgaaggtcaccgaaacgttaccggccaaccagacgtatcaaagctggatgctcagtcaatatcgccaattggcaaagattcaaaaagcaacagccaagtagaaacgccccggttaactgggccaagttctgtgattcagtacgatcaccgttgcaccacgaaaaaaggaccgccattcttgattacaagaatggcggtcctttgggtctaattgcgactagccgaccgattgggcaggcactaatgcctaatttagtggcattctaaatgcctcccacttaatggcagccagtcaccttgattactaatgcggctgcttgcgcccatcacgcaaaagtaaggccagcacgaggccaaccaattcaatcccgagcatcatccagaagaccgtatggtacccttgcaagttcgcacgcaacgttgaggctcccgcttgtttctgagcaagcgtcacgttggataagaccaaggtcgccacggccacacctgctgaaccgagaatttgacgaaccgtcgtaatcacagcggtcccgtgtgagatcagttcatcgggtaatgaattagcccccaatgtgacggcgggcatcatgacaaaagcattcccaccttcaattaaggcagccaacaaaatcatggtgagcaggttcaactctgaattgatcagtgctaagatcagccaaccgacaacgatcatactcataccaagtaacatgatttgtttgtatccgatcttctcggctagtttcccagtaagggggttcaagatactcagaagtaccgcaccgggtaccagtgacatacctgaaacgaatggcgacaccttcaagacaccctgataatagagtgggaagatgatcgtgacgacaattagcgccacgtacgagattgctgttagaaaaatggctaagtcataattaaatgtttttaagacccgtagttccaataacggcgtctccaagtgaaattggcgataagtaaagtaagccaccgctagtactgaaaccgctaataacagccaaccgaacgtccagttcacattgggtttaccaatctcattcacgacgtataaaatcccagcaaagcccagtaacgtcacgattgagagcaaatccagctttgaaggcttattgaccatcacgtccttgatcgttgtgaaactaattaggatcaacaaagttgccaccgtgatgaagacggcaaacaatccgtgccaatcggtaaacttcaaaaccacaccggaaataatcgggccagatgctaatgctgatcccatgaccaacccggcgacacccatcgtactaccccgtttttcctcgggcgtaatcgttagtaaaatggattgatacgagggaaacagcacgccaaccgccgccgctttaattaggcgaccgaccatcatcacaccaaaactgggtgcgaaataaataatgattgagccaatatcgaaaagcaccaaaacggctaagaataatttcttaaacccaatattattcaacaaccacggactgattggcatcatgacgaccattgtcaacataaagccggtcgttaaccattgcacggttgaggccgagatgccaaagtcgcgcataaatgttgggtagaccgtcgacaaggaagactgactgatcgacatggtccaagtcccaagcaacagcgtaaaaatgaaccagaagcgtcgacgccccgtcaacgttacattttgattagctgtctgcattcaaaactcctccttactttagaacagttatcaactactaatatccattgtaccattgaaaccaatgatgtacaggccaaaaatcagattgccaacaaaaaagtttgctatgccaaataaaaggtcatgcacaattagttcgtgacgacacccacgtgaatgattgttaaatatccaatctgttaaggttctaacggataacgcatcagcggattcattaagtggattagaatctaatcgtcaaacggtcaataccaataccaatatgggacattgaccatttgttcatctccaccccatcgtgccgtgaagttgtacagccaaacaaaaaatgggttgttcaagaatcaaattcttgaacaatccatcacctacatgttgcatcgacattcttaatttattcagctaacatggccgcactaactgcctgtagctgcttcgcttcaccggcagtcggcttagcaagtttcatcttctttaaggcgattactgcccgatattgaagttccgccacattaatatcatcccgcaaatcataatgagtaattgtgacgaaggcggagttctcgtaaattttttcaactttagcataaaaatcataatcggtattgccgttcttttgacatttaacccgatcccccacagaaatctgagccataactatcactccacttcataaaatatgataataacatagcacgtaactgctagaataacaattattgctcccgaatttacatgatttttacatggttatgacggataccgtccaaattaaatgacactaggcccagcagccaatatttgcggttagtaatggcaaaattaggcttccaatcttaaaccaatacctagtactttagactgagctgaatgactttatcgcttgaaactagcattcgatttttctacccaaccaaacgtacgccatttacgcctgaggctcaaaatccgagcgctactgtctctcgttttgacagctcccccaccgtccgataagcccagcagtcagccatctccaatacgagcaatgcgcctatcgctattgattcagctcaactggaaacttattcagtccaatgagtgtcattgcagccaataagtagatcgtgccagtaattactagtatgggttgaattccgaatgcgctgatgagtaccgggattcctaatagcccgattggttgtgaaagattcattaaggcaaagtagctgttaaacaccgttcctagttctgattgtggcactcgattttgaaggatcgtcttagacgaaatgtttaaaaacggaatgacgatacctagtaggactaaagcgctcagcgccagtagaagtgtatgcgctagtcctaaaatagatacggcagtcggtaccagcagtagtgcgagctgaatcatgcggttaacattaactttgttacagattattttgtacgttaatgagccgactaaaaaaccaagggaaaagaaagactctagtaagccggtcgatttgggattattaaatatgtaatcagagatttgggttaaataaacgttcattggagctagtagtatattaaacaggattgcggacagatacacgggaatgatgtacggaaacgttgttaaaaaggtcttaacgactttaaaactgttccaaatcggatttgagtgcgccgcagcaggggccgacgtttcagtggataacggcttttttggcactttcaagcacaggatcaagactatgacaattagataagacatgacgtcaaacatgaaaagtggcgtaaacgagagaaaggtcatgccatacgtcacgataattccggagaataaattagcggccgtcatggcactacttatcgatgaattgatactgacatattctgatttatcaaataacagcactgtaatcttaatgatacatggatcgtaaacatcggatacaacagcgtatacagtagccagaacaaccagtaatacgaatgaatggatcttaacaaataccatcatcgcaacacccagaatagttaaagcagctagaaaacttgaccacaggattactttcttttggtcttgccttgaatcaattaaataaccaatcggtgtcgataagaaagtccgcgggagaaataagaaaaaagagtaaataccaacgtatatcggattcttgtaccaggtcgtgattaatatgacgagtgcaatgcgtgagaaggcactcccaaaattattaataaattggctaagtaagataatgttcttattgctcacagattggccctcccttttgaaacagacgcgtttaatttgcagaaggtcgagtgaccatgcatgtgcgcgtcagagggtgtcgctgatactttcggcagcgccgcccttcttcaattaaaaaaaccagcggcgaccccatttttcaatgtaccgtcagactgtctgcatgttggtcaaccaaatgcgttgtttgtgctcaccggatactttgggaagtattctagtgcgccatgcctggaagaaattattaattgcactcttgtttatatgtacggtcgcagattgtagcaactcatgtatttcttcaatagccagcatttggtaagtcgtttgagcgacacactgaatgattgtttacaaagccaccgtgatttaactactagtcccatagatgactaattattcgagaagcatcggatttaaatactccctctaatgttagctattccccctccccttatcctgtagtgattacagagtatagcaacagctaaatgtttttgcaaatgattttcagaaactaattgctgagacttgaaatatttcatcgatcgacatactattcattaactaattaacctggagcggtcattcgatgactatgacaaccactgctaaatatcagggtgtccccacctattgtttggtggggacaccctgatacttagcgcggccacacgtccccgccgtttaaatttcaaaatttagtcttagttcgcccagctggctaatttttgacactccttttttttagatagttaaccaattgccaaccaattaaaacgaccagtaacccaataccaccaatgaaagcactcagccaccattgttcactcgtttgtggtaaccaccccgggctctgatgatgaacagcttgactagcattcggctgacgcacaatcgaatgactcgactttgacgcttcagtcacatgtaactgattagtgccagtgtctgggttcgatgactcagcctggccgtcgaagcgaatcgttgctgggctctcagccgtactagccacaccaataatcggtgctgacaaccacccccaacaaagtagggtactgatggcaattgtgatgaaccccaaacgcttcatcaacaccactcctcctctatatcattatttgcggcataactaaagccaaccctggccgaaaccaatcattaagctggaatagttattatggtacgttgtaaatatacataactaactcgctaacaacaatcaagcagtcttacaaattttatgttacctaatcattatttttttcatcatcgattaggaaccccttgattaagcgtccaagtgaccgtcgcctgatacgtatccgtcaaggcacgatcggttggcacttgtaacgatagtgccccaagtgccattttctgaccgaggacattgacaccttggtttgaaacagtttgatggttattgacgatcaaccgtgccacacctggcgtaagaattgactcgttacccgtttgttgatccttataactgagcacagccgctaatggtcgtgccgactgcttactagtgaaacctgatgctgagagcgttgcattgagcgaccacgttgcccctattgaccgaccatcttgaataactagcccagtatcataggaggcaccgtaattttccgatttaccagtaatcggattctgaccaaaattaatggtctgcggtgctgagacaaatattagccctccaggattgtacattaacgtaatcgtttcatctttgtcggtaaagttcccttgaaccccatctggttgatctggcacgtacccttgaatctcaattggtttaatatgataggcatcaccagttgcaccactgattttcgtgtcgggtgccaaggacttgccagcagcgtccacatacttcactgtaatcgtgttgccagtggcccattcgaattctccaacaatggttttaccatcgtatttagtcatcaaatcagctgacgtataaacttttttattatttaaactacgccatttcccaatataaggtgcctcactactaggatttggcaagtgccaactttcactcttaaaaaagttaaaactggggcccaacaatagacgtttaggcggcaacttcgaactgaaagcgttggtataagtttgcgcactgttggtattccagccagtcagatctaatttgtctagactggtattttggaaagctgattcaaagttagtcaccttggtcgtattccaagcacctagactcaaggtttgtaaacccgaatcctccgcaaatagctgtgaaaaatccgtggctgagcttgcattccagttttcaatgggcagactagttaactgggggttgccataaaacacttgtcccatgtcaacgaccttcgctgtatcccacttaccaactggcagattcttaacttggctaactttggtaaagatacccctcattgtcgtcacattaccagtctgccaattatctactggcaatgccgtgacactactcatttcagaaaaagtccccgccatattttgtacatttttcgtgttccacttactaatcgggagactctttaactgactaactctagaaaaagttccggccatatttgtgacagtaccagtctgccaattatctactggtaacgaggtgagactagtcataccctcaaaagtataaccaagattagtggcactctgggtgttccaattcgcaaccggtgcagtcgttaaactagcacagccactgaaggtcgaattaaaatcaaagactttgccgacattccagttgtcaatcggcagctgggtcaagttagtgtcgccataaaacgtgttccgtaacgtttggacgttacttgtattccaattgtcgagtggcagggacttgatattggggagcttggcaaaggttccatccaacgcagcggcccgactcgtgtcccaattagcgacgttaatactttccaagctagtatcacctgaaaagactaactgcatattaaccacacggcccgtttgccacttatcaatgggtaaatttttaaccttcgacattcctcgaaaaatcgcggacatgttcgtcacgacacgggtgtcccaattagcgacatctaatgacgtcagcgaagaacaatccgtaaacgtccgcatcatcgtcgccactttactggtattccacttgccaactggtaacgacgctaatgaactggcaccattgaaagtgtcaattagatactgtaatgaacccgtgttccaatcggcaacgttcaacgtaactaacttggcacaattttgaaacgttccctccattctgatgacgctgctgacatcccaactattcaagtccaacgcacctaactgtgaacagttcaaaaatagccacgaaatatccgttacgccagttaaattaaggttggcgagcccatcaatcgccgtaacattaggtaagttagcaaacagatacgaataattagtaatagtagttgccgttatcttaccgtcgatgacaatctttgaaacttgggtcggttgataaccgttagctgtcaaggtttttacaatccaactcccagtagctgaccctagcgatgcaccaaatgacccaccactcaaatgcaatgtgccattagtatctaaagtcatcttaaccgtcccattgaccatttctgccgctttggtcgttgccgtttctgatgtttgattatcttcagcactttccagcgttgtactgccaccgctattggtactactgcctgatgttgaattcgactccttgtcaggttccgaactttcctgggcctcaggtgacacttgtggtgccgaatcgtttgccgcatcttgcaacgtcaatttcgaagcagaaaaaacactgctagtcgatggcattttctgatcaacactcaattgtgcgcggggaaccgcccgaataactgtccgtgatccacgatatccgaccacaactagtgctaatgccagtcctaggccgccccgataccataattgccggtgttgcatgcccatcgctcccttcacatagatagtattttaacatctcttgacgttaattatcttacattattttcagtttgtgacgttcagaaaaagacttacaattttacagatatcctaatattaattttttatcaccgtgatattatttgcgttaataaccgtaattaaatgataagtatcagctaacgaacacccatttttatttacttgtttattcagtattcttcacgggtacaactgcacgatggctatttttaaagtgactcacgcccaagccattcttcgaacgaactagatgacttaccaacgctgtaatgtcttttccatcatggcaactgtgaacagccccaattagccaatttatatgttctcacctaacctgctaatgacgataagccgtctgcgttttcttcaattattttaatattcagtaggccacgttcaatctaattgatcagcaagcaacaaaaaaacaattccccgaaatgctgaggaattgttcgtgcttaagatatttaacgacccgtcactacttggtaaacgtccaaacagctgctggggcattgccgaccttaactttaacgatctgatttttagcattaacgaccgtaaacttattggttgctgtatagcgtaaatatagggtcttagtagtcgaacctgacttatagctgactttccagaacgttggcgtcttggcagtcatgctataattcgcatacgagaccagctttttaacttgtttgccattcttataaagcgtctgattaaagccattcttagcgctaaacgttaaaatttgggagtacttgttagtcgtattcgacttccaagtacccgctggcgcgttgactttaaacgatttagttgtcttcttggatgacgaagtggccgccgtcgatttagttgccactttgttagtcgtcttcttagttgaagaggcagtagttttggcagtctgaacacggatgacgcggtagaaataagccttagtcgttggattcgtggcgtacacataaacattgctttgcgccttcaatgtcttggctaatttaaccgtgtactttcccgccgttttagaggccgttgcagttccaagatttttcttggcgttggccgtactttttacagtgatcttagcgcccttggttgccgtacccgtaatttgcgtcgtattattgtaaattgcattgaccttcaaacttggtgcgacattcttcgtagccgttgtcttcttagtcgccgcattcgctgtaatccctgtaacgggtaccgctgctcccagcgttgccaccatggctaaaccagttacagcaatcatcaatttcttcattgatcaagactccttcgttccactggcttacttgtcagcgacttatttacgcctcgtagtatagcagtttttctatcggacaaccgctccttattaataatttaataatctttatactttaattacaactgaatcttatcgaactgattttaaatacgttatcacatccgttaacgacggtacaatcgcagtcgcctgatcagcatagggctggttaggccgtttcatatccggcacacaaattaccggaatcttcgcggacgtcgccgcttgaatgccagcttcactgtcttccagaaccaaacaatctgcaggttgttgttggagtttggcgcatgccatcaaaaatatatctggatatggcttaccacgatcgacatccggtccgaaggtaaactggtcgaaatattgcgccacatcatgggacgtcaaaatgtctaatgcccgcgacttgatactagatgaagctaaggccactgaataatgattccggtgtaaaaactgcaacaacacccgtgctcccggtttgagctcaacgccatcctgcataaacgtcttttccaacgctaacgcccgctttaatccagtatcaacatcaaacggcaagtcaaaacgttcaatcaagtgttgcatattcgtcaccgccgacttaccactgtattcctgtgcataagtcgccatggaaagcgtctgcccataatcctgtacgatttgttgatacatctttaatgaaataacctcactatcaatcaataatccatctaaatcaaaaataactgccttcgtcatactcaccaactccagtctatttatcgttaataatctaagcttatcataactgtttaaaaatgtaagcggagtcattgctactaatattaagtttcaaaactaaatctggttattgacggtttggtaattaacacttatactactagatagtaatactatctagttaaaggagattactagttgaaacaaacacaattgctcaaaggtgtgctcgacggctgtgtgttggccattattgcggaccatgaaatttacggttatgaattgattcaggcattacgtgcagacggctttgattcaatcgttggtggcacactttatcccctacttgcaaaactggaaaatcgtggcgatcttattgggcaattcaaagcttctcctgatggtccccagcgaaaatactatgccatcacccctcaaggtttacaaacactaacaacttttaatcaccagtggtttcagttaaaagcgcatgtcgatcacattttaacgaggaggaccccatcatgaccaaaattgataatgaccaggcacagctcaatcaacttgaacaccaactcacccttagtgatgcacaatacttccacgatttacgcctttatttgctgaccaaagagctgttcagaagcaacgaaaaggccattacacgccaactcttgacgatgctacaagacttcctagacgccagccagcatggcgaaacagcctcacaattttttggtaacgatccagccgggctcgcagatacactcctagccgaattaccgcgcaatggtcgctggcaacaaattcacttcgttggcgtgttagtcctgattagctggttcttcgttatattaaatgctaatacggcaacaggatttcgtctgaactggttacttcttttcgccgccccactagtcgagattatcgccatagcgctgattttcaaaattatgaatcatgcggtttatgctgatagtacgccatttaaacaggaaaccgttccggttgttttaataaccactttgaccctagttattctgattggactcttcttaattacgccacgttttggttcttgggtatttatctttttgccgaatccttggggcattgggctacaaatcatccaggctatcatcacagtcagctggtttggttacagtttactgtctaatcatcgtcaaccgacccaacattaactccccctaatcaaaaatggtacgccagaatgttttcattcttgacgcaccatttttaatttaaactcattgtctataaatcgtctcgatgcaacaaggcaatctcctcacccgcggctcggcggcgatcaatattatcctctccccacacgcacagctcatgtaagacaacggacaaactccggccataatcacttaatccatattccacgcgcggtggcacttgttggtacactttgcgcgtcacaatattagctgcttccaactctctaagttgttgtactaacattttctgcgagatttgtggaatcgcccgttccaattcgctcgtccgcatcgtctgagtacgcagatggcacaaaataattgatttccacttacccccgataatttccattgtggcctcgaccccaatatgataagttttggtttccaataattgtccctccatttcacacttactttttggtgggtatcccactttaaagtcggtacttgtctaaaagtcacttgctagtataatcattatttatcaacttagcaatagcaggaggcttatcttatgacaaaacagtttaatcccagttggacacttttggcactcgcaatcagtgccttcgccattgggtcaacggaatttattagtgttggtttaatgccactactcgttagtagctttcacatcaacttggcgcaagccgggctgaccgtctcgatctacgccattggtatcatgattggtgcgcccgtcatgacattactcaccggtcggcttaaccgtcaccgcttgatgatgttaattatggttttatttattattggtaacttactcgcagcaagtgccccaacctttggtgtcttacttgcaggccgggtcgtggccgctttggctcacggtatttttatgaccgtcgcctcagtaattgccgctgacgtagtcgcacctgccaaacgggcctcggcgattgccatcatgtttacaggactgactgtcgcaacggttaccggtgttccgttggggacaatgattggtcaattaggcggttggcgctggtcctttatctttattagcgtgattggtgtcattggtttgttagctgattactggttgattccacgtaatctgccgttacccagcaaagccaaggtccgggggattatccgcgtactcactaatccacaactactgttcgccttactcgtcacggcgctgggatacggtggtaccttcgtagtttacacctacctatcaccactactagaacagcagatgcattggtcagcgagcgctgtcgttttgattctagtcgtttacggcttaatggtcgcccttggtaatacactgggtggtcgttgggccaatgcacggcccttaattgcactattcaagatgttcagtgggttactcatcaccttactcattctaagtgtcaccgggtacagtcactggttaggactattgaccgtcctactgatgggaatctttgccttcatgaacgtccctgggctccaactctatattgttcagttagctgaacagaatacaccacacgatattacgatggcctcagcgttaaatatttccgcttttaacgtcggtatcgcactcggctccggtattggtggtcaagtcacgaccaaccttggcttaggctggacaccgatctttggtgccatcatggttgctgttagcttagtcctattgttaggtctaatttggttagcgcggcccgcaaaaagcaccgaccggcattgcgttcaaaattaataactaaatgacccgtagtcgtcttaaacggtcatcgagaacactaagcttagcggcttaacaatgaccgccaattcggttgtcctatcgctaggctgagtgtttttctttatgtcactatcttttaaatccacttaaccgtcactagttcaggaacctcattaggaggcgactcggaatgttagcaatgaatcgtcccgattttcaccggcagccttcctacttttagttgggatttattgtttattttcagtgttatttgaagactaattattgccattttaggctgtcttaattgacttaaagcccgaatatgcccgctttacgccattgcgaccccgatttgttcgtaaaaccgacttatccagcattcgactgggttgcattttcactttcagaaagctataacggtaatatacgattggttttcacttttactgagaaggtcctgattgaatggtcagtattgactattaccactaactatcaagccagagccaggcaggaccaaccaactatgggggcgcaacatgcaacgcaaatcaacattaattttattaactagcatcactttagttatcggcttactggcggtcggcactgtcaaagttgttggtgatgcccacagacctagccaatcagcggtagccaccaaaaaagtcgtgtcaaagacgaaagccaaaaccacggctaaatcaacggtcatgcgcacaccaatcaactggcgtcaatcatccgaaacagtcacgtaccccaatgtcaaccgctatccggacttatggattcacgtatcgttggctaaacaacggctatacttgatgaaccatcaccacgttctctatacgatgtatgcatccagtggcgtgccaactgctgaccgcaaaacaccccgtggcacctatcatgtgcaagccgaacgggggaaatatttttatagtgctagtgttgatgaaggtgcctattactgggtctcatggctcaaccatggtgaatacttgttccactccacacccgtagatgcccaaggtcactttatcaaatcagacgctgctaatcttggcaagcgaccgtcttcacacggttgcattcatctgagcgttgcagattccaagtgggtctataacaacatcaagtatggcactaaagtcgtcatcgactaacaaaacaactacaaaaccaccaaaataaatcatccagcaacctatttgtattaagacaatcaggtcgctggatgatttttattatcattggcacgtcgaacgagttcttatttagctttaatatgaacagcttagccgatctcgacttgttcagcaagatgattggccgttacactatccattaacataccagcttccacgtatagcttatgccacatcatgaaggtcagcacggtccacaattgacgcgaatgatcacgaacacccgctcgatggtcatccaatagtttcaagaaatatgtcttatcaaaatactgattggtttgcgacgtcacaataatatttttagcccaatcatacatctcatctttgagccacaaccgaatcggtactggaaaaccaagctttttgcgatataacacgtgcgcgggtacaatatcttcaaccgcttttcgtaaaatgtacttcgtcgtaccgtggctaattcgcaagttggctggaatttccgctgccagattgaacacctcccgatcaacaaagggtgtccgcaattcaaggctgtgggctaacgccgtccggtccgcattatgcaacaaatccccatttaaccacgtgtgcatatcgataaactgcatcttagagattaaatcatagtgcttggcttcatcgtaaaagacccgggttgtctgttgaaacgaatggtcacgattgtagtgcttcatgaactgttgcttctcagtttcattgaagataaacgcattgccaacgtaccgcttctctaacggggtcgtcccccgcataagcaacgaacgaccccgcattcctgctggcatcatcgcggctatccgttgaagggccccgttgattggcttcgtataccgaaaggctttcaaggattcgggctcatgataaatcgtatacccgccaaaaagttcatcagccccttcaccggtgagacaaactttaacgtgtttgacggcttccttagtcaagaaatactgcgggacagcagccggatcagctaacggatcatccatgctccagacaaaatgtggaaaggctgccatgaatgcttccggcgtgatggtcatttgaacgttatcgacattcaacttagcagccgtttcctgcgcgacgtctaattcactatagccaggtcgttcaaagcccactgagattgtcttgagatttggattgaactgcttggcaatcgccaccacaattgacgaatcaatcccgctcgataagaacgccccaactgggacatcggaacgcatatggattttaaccgaatcaatcaacgtctccttaagccgtgtcgcgtagtcctgttcagaacggacgactggatgaaactcccgatgataataacgcttgatttgcggcgcgtgtcccaactgttttgttaatgaacagcccggcgccagcatcttgatttcctttgtcagggtctcagtttccggcacatattggaacgtcaaataatcttgtaacgccttttgatcaaaatgcttatcttttaaaatcttataaatcgccttactctcagacgcatagtaaaaatcattcccggcaatcgcataataaaacggtttgattccaaattggtcacgcgccgcgaataacgttttttcctgtttatcccagatcacaaaggcaaacattccccgcagataggtcgtcaacttggcccggtatttggcgtacatccctaagatcacttccgaatcggaatccgtcttaaacgtgtagccttcttgaattaactgttcacgtagctcaacatagttataaatctcaccattaaacgttagccaataacgttcattatcatatgacagcggttgatgaccacctgccaaatcaataatacttaatcggcgaaaccccatcgtgatattatcatccgcaaagtacccctcatcatccggaccccgatgcacaatcattttagtcatttcccgcacaacctgatcatacgcggcattatcaacttttcgccgatccgttaagcacccaaccaatccacacattctattcactcccacacttaagttattgcgactaatcaccaatattgtcgttagtgaccaatcacaagtcacgctcaaatcataggcaatgcccagtacggcgatttgacttgcggaataacggcaagccaaccttgaccataattaacagccgcacttgtagcgaacataacccacttgattcaaactggttgcttctaattataatttagtgtggcccgtcgcaacagccgttttaagacaggcggactaaccattacactacattaagaccttatttggcccattgaagataagttaaaaataaacgcaagcgaattgattggaacggcccagctcaggttcataattcagtacacctgaataagacgtaaaaaaataaccgtttcagggaaatcaaatttctgaaacgattattttaccagttagcaaaccgaatcttgccaatctgaattttactgccgtcaatataaatcgactaagatttcaatcagcgattgtttttgccaatctgccttactaagtagcgactggccgctgcggaacacaggacggtttcaccgttagccatcgttagtcgccgataccgtttatccaatgaccgaatgcgggtcagattaacgacatatgacttatgacaacgataaaaatcagaattcaaatccggcacatcctttaataaaccgtaatattcaagttcaccatcatctaaatgaacgataatcttatgtgggctcattgaactttcaaaaaataacacgtgttgcacgtccaacgatcgaatcgtctcaccaattttgatctggatataactattttgatcattgtcttcagctttgaaacgctcctgtgccacgcgtaagacggtatttaatcgctcgtataagcgatccggaaaatccttcaagataaaatccagggcttccacttgatactgaaacaccgtcaatgatagctccgtatgcgtcgtcacaaagataatcttacttcggatgcctaaatcacgaatttgactggcaagctgaatgccattaatatccgaattcaacgcaatatctaaaagaaagacggcttgagttggttgctgacttttgacatgcgctaatacttcatgcggatcggcactcgttaggccaaatcccatatccaattgacgatcaataatcactttactgaccagttgctgcaaggtttgtaactgtttagtatcatcttcacaaatatatactttgatcattttatcattcccgctttaccgttaaacgctggacaaaggttgaggccaataaccgcgtttccaatatcatattttcgtttcgattaacaattgcgctgagctgactcaaccctaaaccccgctcttgtcccttagtcgaataccccgcttcctttagttgccataaaggtggcaaggaatcaaaaacgttattttgaactaagaacaccgtactgtgggccgtaacaaaaatggcgctcatcagctcaccatgatagtgaccggccgtggcttcaatcgcgttatctaaaataatacctagcgcaattgccaaatctaattcattcgtcgttaccccattaagtacttgcttcaagtcaaattgaactttaaccccctgcgattgcgcatagctgagtttgctaaatagaatactcttgaccgatttgacctgaacacgacttaaatcttcgagattatactgctcatccgaaacgcgcttggtcactggggcaatattttgttggtaatattgctgtaagcctgccaaatcatccgttttcaaatactcattaatcgacaacattatattctgataatcatgacgaaaccggcgcaattcattataatgcgtttcgatttcatgcatgtaccgtgtatcatttttgatttgcaggcgttgttgttgaacctggtacttggcccgaatcgtaacccgatactcatcatagatggcaatcgcgagtcccataacgaccaacaacacaactaagttactgacgaccattctcaattcactgtcgagtccctcgctgacaataatgtataaatagatggcaagtagcagcaaggccgtaacccggttcagtctgggacgattgaatgtcgtctggatatgcgtattcattaaaatcagattcaatgtgattaaaccaaccagctgtaatcccataaaaatcaaaagatacccgtcatctaatttcaacatatacgttaaaagtgaactgatatgatcgacgacaattgaccagataatcacctgtaggctaacaaataatgactcactgaagctatgtgtatgccaccaagtaaacagcaccaccagtcccaataatggcaatgctgcatattgcccgatcactgaaaaaatccagccgctgactaggctactgaccaccgcataactgatgtcccaaatactaagtacccgccaatcacgcaaaagcaccttaacgaacaagaataggaacagcgtttgcacaaaaataatcttcatcagctgccccacagctccagtctactcatcattaacaccaccattttgccggcacacctattttgattatgactaatcaatacaaccggtaccttcgtttcactgaatcgttttgcccactgtaccatccaaagtcccccttacatattggttgtcccaacgagtacctacagtttaaaacactcaccaacacttgaaaagaatacacaatgaaccgaattattcaaccagcctttaagatactaaaccgtcacttcaagacgactagtcgctacatgcacgcatacataagcgcaaaaaaagacgcgacctaattgatgaccactcatgtctatcaattaggtcgcgtcttcaaacctcctaatcttgtttcattgcgtcccaaatcatttggaaaatatcatcaaatgtatattgatcctgagcataccgtcccttactgatattcgtcgtatgcgtatgaatagttgaaaacacgacccccatatgcaaactaaccggtaactgcttaatcaccttagcatcgatagccgccgttaataagttagcgacaatattattcggatcggcatccgccgccgaaatcgtcatcccctgtccattcaatgccttgatctgttgaatgatcgtcaagctatctgggttggctaacgaatagtcgtacacctgctgcacgtataatcgaatccgagtcgtcacatcgattgttgaatcacttaatcggtctaagtcggtagtactaagaattcggttcgtctcacgcgcatagacactatcgatcagagcctgtttattcttaaagtagagataaacattggattgtgcaatgccgacgcgcttagccaccttagtcgttgaaaccccggctggaccctcggcgagaatgattgccgcaaccgcatcttgaatcttaacttgtttgttcatatcttttttcttcatgccttcagtataaaagataaaaatatctttttcaagcttgacaaagatagaattatcttttaagctagtaatcgttgaaagatagatttatcttttaaaaataaaaatcaaattttaaagaggttatataattatgaaaattgcaatgttaggttcattaggaaacattaatcggatcgttgttcctaagctcgtccaagccggtcatgacgtcaccgttatctcaactagtcctaagcgccaagcttcaattgaagctgtcggcgcccatgccgccattggtacaatgactgatgttgatttcttatccaccacttttactggcaaagatgtggtttacctcatgctttctggtggtatcggtgacgatcccttcgaaggggccgtggctcaggctaagatttggaaacaggcaattgaagatgccggcgtcaccaacgtcgtcaacctcagtagcatcggcgcagatgccgatgaagtggctggctcgctgcatgcttacaacttaattgaacatgaattacgacaacttgacggggttaacctggcttttgtccgtccaaccggattttatgctaacttgttcggtagcttagcaacaatcaaggctgaacataaaatttattccagcacgcctgctgcttcagcacaaaaatacgttgcgcccgaggacattgccagtgtcgtttatcccctaattgatcacacgccagccggtatcaccatcaagtatgccttcagtgatacgttcaccggtgaccaattcgttgctgatctgcgcgacgccttaaacatgcccgatctacaatgggtacaaatctcagatgaacaatatcaagctaacttgacgaaccacggtgttcccgttaaaattgccgcttcattagtccaaactagtcgctatcagcgcgaacctgaaggactttatgcagacctaaatgcttctgacacgagcgctggtcaagtcaaattagctgactttgtccgtacttttgtggtagcgtacaatagtgaaggcggttaccagtcccatacaatcgcagattaaccgcttacaacatctgaacatttataggaggagtttactatggcttatcaaacaattaatccatataccaatgaagttgttaaaacttacgacaacgcgaccgctgaccaaatcgaacaggccttaactaccggcgacgccctttatcaccaatggcgtcatgaacccgttagttcccgtgcagccagcctccataagattgccgcactgttacgtgaacataaagatgaattagctaaaattgcaacaatcgacatgggtaaattattgagtgaatctcaaggtgaagtcgaactatgtgccatgattgctgattactacgctgatcacggtgctgaattattagcaccgaccccaatcagcactcaagcaacgggcgatgccgaaattgaaaagcaagcaaccggtgtcttgatgctggtcgaaccttggaacttcccatactaccaaatcatgcgggtcttcgcaccgaactacatggtcggcaatccaatgattttaaagcacgcctctaatacaccgggttcagcggcagccttcgccaagattgtcgaagaagctggtgctcccgctggtagtctaacgaacctcttcttaaactatgatcaagttagcgatattattgccgacccccgcatccaaggcgtcgcactcactggctctaagcgtggtggccaagcggtagccaaagcggccggtgcgaacttgaagaagagttctatggaattaggtggttcggacgcgttcgtcgtcttagcggatgctgatattgacgaagcagtcaacttagcatggcgggtccggttatacaatgctgggcaagtctgcacctcatcaaaacgctttattgtcgctgcggatgtgtacgatgatttcttagcaaagttgaaggaacgttttgccaaattagtccctggcgatcctatggacccacaaactaccttggcaccaatgaattccaagcgtgctaaggaaaaactacaagaccaggttgaccgggccgttgccggtggtgcaaccgttgcttatggcaacgaaccaatcgacttacctggccaattcttccaaccaaccatcttaacggacatcgatcaagacaaccccctcttttacgaagaaatgtttggtccagttgcccaagtcttcaaagttgattctgaacaagcagctatcgatttagccaataactctgaactgggcttaggcggcatcgtcttcgccgggactgcggcgcatggtaaagcggttgcccaacagattgaaactgggatggtcttcgttaacaccttcctcagctccttaccagaactaccatttggtggcgtcaagggctccggctatggtcgcgagttaagtagcctgggcttaatggcctttgttaacgaaaagttagtcgttactgctcaaaaacctgactacgacaacggtgctggtggactagttgttttatagtgattattagtcagaagttcctactcccggctagaataaggatatatttgtgataactcgttgacttgctacgtgagctcaaaacgacgtcggggacgttctagcacttgtagccagttttcacagattgaaccaacaactttatcgcaacacaaaacaggctttgaaatcgcgtcgtttgacgttatttttggtctgattctgttaacgttaacattacgaaaacgcttgcgaaagcgtttgcacagatgcataatagattatggtaaatgaattaagatacttcgcaaggaggaagcactatgagtacttggaaaaagttggggatgggtgtcctagccactggtttagcactcacgctcgtaggttgtggtaatagtaaatcttcatctagcagttcaaagatggacaaaacgttaaaggtttcagcggatccttcatataagtcatatatgaagtcggtgattccaaagtttgaaaagaagtacaacgttaaggtcaaggtctcatacaaggctatgcttgatgaagacgatgctttgaagttggatggtccttccggtaagggtcctgatgttttgatggcaccatacgaccgggttggccaaatggcgtcacaaggccaattgtcaacagttaagttggccagtggtcgttacaacgcaacggggaagaaatctgttacttataagaacaaggtttatgcagcgcctgtaacgattgaatctgacgttctgtactacaacaagaagttaattaagactgcacctaagaatttcaaggaacttgaaaagttagcttccgacaagaagtatgcttacgctaacgataagactaagtcagttgccttcttgactcagtggacgaacttctacaatgcctttggtgtcatcaaaggttacggtggttacgtctttgctgatggcaacacgaacgctaagaagatgggcttgaacaattctggcgccgttgaaggtttaacttacatgacgaagtggttcacgaagtactggccaagtgggatgcaaaatgtcacttctaacgaaaactttgtgacctcacaatttacgtctaacaagaccgctgctgttattgatggcccttggatggctgcaacttacaagaagtctaacatcgattatggtgttgccgtcttacctaagttgaataacggtaaagattatcaagcgtttgccggtggtaaagcttgggcaatctcaaactactctaagcacaagactgctgcacaagcttggttagacttcatctctaacaagactaaccaaaacaagctgtacaagtctgctagtgaaattccagcaaacacggctgctcgtaaggaagctgtaagtactggtgatgacatggccacggccgtttcaaagcaatacgacaaggatgttcctttgatcaacttaccacaaatgtcagaagtttggacaccagcacaaacaatggttaccaacgctgctagtggcaagatgacaccaaagcaagctgctaataaagcacaaaagacgatcttaactaatatctcacaaaagtatgataagtaattaaaattgtaatttaagggggctgaaacaaaattcgttttgtctcagcctttttaaaaggaaaaatgcacgacatttagaatttatttaggaaaggggtgcgggcgacatgcaagtaaaagatgttaaaaaagcgcaacgcctgtcaattattcccgggctcggtcagctgtataacggccagaccataaaaggtgttggtttcatcattattctgttggcatttgttgctgagttcgtcttcggcggtttcagcgcatttgctaacttagtcacattgggttcggtctcaatggaagacaattcgttgttcatgatgatctatgggacgttacaaattttgttgacgattgtgttcgttgtattttatattgcgaacctttacgatgcgaagcacgttgcgcaattaattaataatggtaaaaaggtttcccatacgtttaaagaattaggtgcaagcttagtggatggtggttttgcttatttattaaccacaccagcctacttcttaatgattttcacgattgtgttcccagtgctggttacactgctaatggcctttacgaactatgactttgcgcatattccaccggctatgctgttggattggatcggattcaagaacttcacctcaatgttcttcttgagtagttaccgggccaccttcaacgccgtctttggttggaccgttatttggaccgtatgtgcaaccacgttacaaattattatcgggattgccaccgcggttattgctaaccaaaactttatcaagggtaaacgcttcttcggagtgattttcttacttccttgggcgatcccagcgtttgtttctatcatgagtttttcaaatattttcaacgattcggctggtgcgatcaacgtgcaagtcattggcttatggaacaccttagttccatttgcccacattgcgccgattcactggatgacggatacgttctggactaaagttgctattattatgattcaaggctggttaggattcccatacatctacgttatgattactgggattctacaagcgattccagaagatctctacgaagccgcaacgcttgatggtgcgacggtgatgcaaaagttcaacaagattacgttaccaacgatttttgccattgcagcgccaatctttgtgacgcagtatacgtttaacttcaataacttctcgatgatttatctgtttaaccaaggtggccctggtgatgtcggtgctaacgctggtgggacggatatcctaatctcgtggatctacaagttaacgacggggacgtcaccacagtactcattggctgcggccgttacgttgattatttccgtcttagttatcgggatctcattgattgtcttcaagaagacccacgcgtttgaaatgggggactagtgttatggataatgcacaagcagtggcacctaagaatgccaattcaaagcaaaatagcgcgcgtcggcaccgtttctggaaagaattctttacgtatctgtatatggtcattctcggaattattattatctatcccgttttgatcacattcatcacggcgtttaaggatgctaacgtgcaagccttcgtccttgattttggtggtaagtggacgttggttaactttaagaacttatttacgcaaaccttgtatggtagctggtatctgaataccatgattatttcagtttcatgtatggtcattcaagtcatcgttgtgacgttagccggctacgtttatagtcgttaccgctttgcgggtaagaaattcagtttaacgtttttcatcgtgattcagatggtgccaaccatggccgctttgactgcttactatgtcttagctaacatgttgaacgccttggaccactactggttcttgactgcaatttacattggtggtgggattccacagaatacttggttgatgaaagggtactttgacaatgttccgtacgatttggatgaatcagctaagttggatggtgctggtaatttcaagattttctggtcaattgtcttaccactagttaaaccgatgattgcggttcaagcattatgggctttcatgtcaccagttcaagattacttgatggcgaagttcttattgacgtctgaatcacattacacggttgccgttgggctccagacattcattaataacgcgcaaaatcaacaagttgtgctcttctcagcgggggccatcttagtcgcgttaccaattgcggccttgttcttctacttacaacggttcttcgtttcaggattgctcgctggtggcagcaagggttaatttaaatattagtaggggtgaaattagatgcagagtacgaaaaacaaaacaaccgcctttccggtccggttttttggtagcctcttctcacctcgaagaatgtttgccaaccgagaccagtttaattggttacagattattgttttatttatctttttgaccgcagtaatggtcatgccgattccgttttactataatcaccaaacgaattttaatctgtcaccatttttaccacacattgataaaatgatggccagtgatcagatgcaaacggcaatgaagtctgcaaactacggtgatcagcggttcaaggatgttaaacatcaagttattatcagaactaaagataatgttgccggctttgatctcacgaacgatgacatggcaggacgcaagaatgtcattaatttacatgctagtacgtttcaagtgaaatcagtcggtagtgaatttaaagccaagtatgtgccaggccataatttaaagacaaacgcccatgcgtttctggttaattcttggtatcaaagtaataaagtgatgattggtctatttatgctcatggcacttggattaattatcgtgggggtcaacctgatcctcgtgaatggggcggcgttcttcttgttcttgtcgcgacataataagattacgcatattcgtaatttccgcgaaggcgttaacttaacgttgatgatgatgggaatcgggagtctgctagcgatggtgattggcttaattcactttgatgtcaccatcgaattgaccgtgcagtccctcagtttggccttcgttgtgttatgggtatatctgaaaacaaaattcaaagatccggaagttgaccaaaccatgttgctctaggtcaattagtaagcatagaaatgaggaagattaatggcacgcgatacgcaaacgcaattacgtaacgagatgatttactcagtctttgttagaaactattcagaagctggtaattttgctggcgtaactgctgacttacaacgaattaaggatttaggaaccgatattttgtggctactgccaatcaatccgattggtgaggttaatcgtaaagggacacttggttcgccatatgcgatcaaagactaccgtgggattaatccggaatacgggactttagctgactttaaagcactcacagataaggcgcatgaattagggatgaaagtgatgttagacattgtctataatcacacttcgcctgactcagtcttagcaaccgaacatccagattggttttatcacgactcggatggtcagctgatgaataaggtcggtgactggagtgacgttaaagatttagactatggtcaccatgagttgtggcagtatcaaatcgacacactcttgtattggagtcaatttgttgacggttaccgttgtgatgttgcgccattagtgccacttgatttctggcttgaagcgcggaaacaggttaacgcgaagtatcctggaacgctatggttagcggagtcggccggcagtggctttattgaggaactgcggtcacaaggctacaccggtttgtctgacagtgagctttatcaagcctttgatatgacatacgattacgacgttttcggtgatttcaaggattattggcaagggcgcagtacggtcgaacggtatgttgacttgttacaacgccaagatgccactttccctggtaattatgtcaagatgcgcttcttggaaaatcatgataacgcacgcatgatgagcttgatgcacagcaaagctgaagccgttaataatttgacctggatcttcatgcaacgtggtgttccgttaatctataacgggcaagaatttttggccgaacaccaaccgtcattgttcgatcgggacaccatggttgctgatcgtcatggggatgtgacgccactgattcagaagctagtgactattaagcaactaccattactgcgcgctgcggactaccaattggcagtcgtagaagatggaatcgttaagatcacttaccgtgcggctggcgaagcgttaacagcctggattccgctaaaaggtcaggtcacaacagttgcgactaagctagcagcaggtagctatcaaaatctgttaacggatggtcctaccgaagttgtggatggcaagctgacagttgatggtcaaccagtattaattaaatatgccaccaatacggcggtgactaaagttgctgaccagtccaactagctgattaacagctttgaataagcgatcaaaaagcaaccgtttgcggacgattgcacgtgtaatagtagtttagaagtgagaaaacaagggagtggatttcgatggttgaaatgaatctcgatcacatttacaaaaaatatgagggtaacgataaatattcagttaccgatatgaatcttgatattaaagatggtgagttcatcttcttcattggcccatctggttgtggtaagtcaacgacattacggatgattgctggcttggaagacatcactaagggtgacttcaagatgaatggtcaggtcatgaatgacgtggaaccaaaaaatcgtgatatcgcaatggttttccaaacttatgcactatacccaaacatgtcagtctttgacaacatggcctttggattgaagattcggaaaacttacagtaatactgaaatcaaaaagcgagtggataacgctgctgagcaactgggcttaaccgattatctacaacggaaaccagccaatttatctggtggtcaacggcaacgggttgccttagggcgggccatcgttcgggacgcggggacgttcttattggacgaaccgttatctaacttggatgctaagttgcgggtcgacatgcggaccacgattgcccaaatgcatcaacgcttgaagaccaacatgatctatgtcacccatgatcaaattgaagcgatgacgatggctgaccgaatcgtcattatgaatgacggcaagatcatgcaagttgggacgccacatgaattgtataacgaaccggtcaatcaatttgtggctggcttcatggggtcaccatcaatgaacttcttcaatgccaccttgcatgatggccgtgtgactgatggcgaaggacttgacgtggctgtaccagaaggccaattaaaagtcttaaaggcccagggctatgaccagaagaaaatgatcgtgggtatccggccagaagatattcacgctgaacaaatcgcacttgaagcgatgcctaattcaatcgtcaagacgaaggttatggtttctgaattcttgggtgccgaaagcatgctttattgcacagctggcaagtctaagtttaccgctcaagtggatgcccgtgattatcataacccaggtgagaatgtggaagttgcatttgaaatgtcaaaagcccacttctttgattctgaaactaaggatgttattcggtaatttcgaacgacggaggagcaacaacaatgaaacgtatttttgaagtagatccgtggcacgtcattagtcatgaactcgtaccgacggataagcgactacaggaaagcatgaccagtattggtaacggctacatgggtatgcggggaatgtttgaagaacattattctaacgataccctcaaagggatttatatcggcggggtctggtatcccgataagacccgagtcggctggtggaagaatggttatcccgattatttcggtaaggtgatcaattcggttaatttcatcaaagttaatattacgatcgatggcgatcaggttgatttggcgaaggacacggtcagtgactttacgttagatcttgatatgcatgcggggatcttgcggcggtcattcattattaccaagggtgaaaagcgcgtccaattcatgattgatcggttcgtcagtgtggcacaaaaagagttatttgatgtgcactatagtgttcacaacttgagtgcggaaccggttcaaatagggtttatttcgcagattgatgcggacgtcttcaatgaagatgcgaactatgacgagcagttctggcaagtgctagataagagtcatgccatcactggtggcagtatgtttgcggaaacgaagccgaataacttcggaacaccgcgctttacgctcggtatgcagatgcttcatgaaacggcttttcgggggattaacgtaccagaaaccgaaaaggcggtcacgaatatcttccgaggcacgttagcaccggatgaaaccaagaactttgaaaaacgggtcctcgtggtgacttcacgggattacgcggacatggcggcgatgcggactggcttagctgaattaagcgaaacgattcgcgcgcaatcatatgaagatttgcggcaagcccatgttgatggttgggccaaacgttggcagttatctgatgtattgatcgacggtgacgacgcggcgcaacaaggtattcgcttcaacctgttccaattattctcgacctactatggcgaagataagcgcctgaacttggggccaaaaggctttactggtgaaaagtatggtggtgcgacgtattgggataccgaagcgttcggagtaccgttctacctctcattggcgaaaccagaagtaacggagaacttactggaataccggtataatcagcttgctggagctttccataatgctaaaatgcagggcctggccggtgccttgtacccgatggtgaccttcaacggaattgagtgccataacgaatgggagattacgttcgaagagattcatcgaaatgggtctattgcgtatgccatcttcaattacacgcgttataccggtgatgagacctacttgaagactaaagggatcgacgttttaacggggatttcacgtttttgggctgatcgggtccacttctcagaacggaaacaacagtatatgattcacggtgtcactggtcctaatgagtatgaaaacaacgtgaataacaattggtatacgaactttatggcgcgctggacgttagaatacacgttagcgagtttgaagaaagtggatgccgctaagcgtgcagcacttcaaatcacggatgctgagcttgcaaagtggcaggatattgttgaccggatgtacttcccacatgatgaagaattgggaatcttcgttcaacaagatggcttccttgataaggatgtcaagccagtttcaagtattcctgctgatcaacggccaatcaatcaacactggtcatgggatcatattctacggtcaccgtatatcaagcaggcggatgtcttgcaaggaatctattacttcatggataaattcacggcggaacagaagaaacgtaactttgacttctatgaaccgctgaccgtccacgaatccagtctttcaccagcggtccacgcgattctagcggcggacttgcactatgaggataaggccgtggaaatgtatgaacggacagcccgtcttgatcttgataattataataatgatacggtcgacggcttgcatattacgtcgatgaccggttcatggctcgcaatcgttcaaggctttgctggtatgcgagttaaggatgataccttagcctttgcaccgtttgtacctaaggcgtggacccattaccaattccacgttaacttccgtggtcgcttgatcaaagtggatgtcgatcaacaaggcacgaccgttgaactggtcagtggggaaccactgactatcgacctcaatgggcaagctatcgaggtcgctagcaccgtaacaactaagtaaatatgaacgcttgattgtggcctggccgtaactgaccgcaatcaagtttccaccctaagaatgagcttagattcattccaacctaacttctaaatgggtccgtatcagctgatgcgggcctttttagtatatggacataaaaagagcccctcacgtgggaatagcgatttccaagtgaggggctcggttgttctattaaaagagcatcgggagggttatttgagtgtttgcgtcaatcctagcacgtccatttcgtaaatccgaacggcggtgtcagcaacttgggttggtttatcaacaaccaaccggacgtagcgcgccgaggtggccgcgaaagtattgagactagtggcctgtgtgttattgtaggtccgagcaacgtccgtgtagcgtttgccatcagtgctgacttgaatggtccaagcgcgggtattcatatcagccccttcgccaccagctttagcgtgtgctaatttgactgcactcacagtcgtttgacggcctaaatccagcgtcaaggtatgcggtgccttgccggttgcacaccatttagtatcgagtttcccgtccaccgccattttaggtgcttcactactgttcgtgtatccggaggcgctggtcttggcgttcttggatagcaaggttaaagtacctttggctttcggtgtaatcgtaatgagctttttcattgtaacgtgccgttggccatccttgtttttagcggttaatgtgacgttataagtaccggctttacggtaagtgaccgtggggttcttggcggtactggtcgtcttcgtggcaccgtcaaattcccatttatagctggttgcattcttggatgagtcgtttgtaaacttaatcgtgctaccgggagctgccaaggtccggttaaccgtaaacgctgctttaggtttgcgattgtccggccatttcagggtgacatcagcggatgcatcgccacgttggttccagatatcaactggaacgaccatcagcttggtttcgttgtgttgtccattgcgttccaacgcgttgagatagaaattggtcgtgttagtagcccccagaaatgagcgggaaccgtcattgttgacctgataaacttcgtaatgatccagcttgtttttagcggtggcttgccaactcaggttaacaccagcatacttgccttcttcgtcgaacgtccgattatcaattttgacccggttgaccttttctggtgcgacttgctgcttaccggtaattgcgaggcgccctaattgagcgctgtagctagcatcggtctcagcagcgctgattttgagactaaggcccttgatcgtttttttcgttaacttactaacgtcatagctaacggtcgtccagtgcttgccgagtgtccggtcacccgtgatggtcttagtgcggccgtcctttaaggttactactagtttagctgatgatttacccgatgctttggcagtcaaactaacccgggtattggcagtgacgtctaggtccgtggtatagagcttgattgtgctagcggtatccttacgcatcttaccggctaacttgatatcattgccaccctcgtaggcgtcagtgtagtcaaagctggcctttaacgcattaccactgccgttatcaatcaaccagcgataggtcgggttgaccgcttgtagcgaacgattgttccaatcacgtagcgaaacgtttttccctttaatgaagtagttatagccgttacctaagctgaaattagtgacaaagggctgtttcgtaatggcactttgttcaaccgcgtatgttgagacgcccggccaacgtgttgaagtagtcgacggaacgctacgggacggatcattttgatcattgacccacagtgcgccctccttggcctgaaattcgtcaaccgtatcagaagaagcgtgggtccagtccggcgcgtacaaccctagcgacgtgtacggcacatgctgcttattagcgaatagatcccaacgaacgggggtcgcggtcccgtcagcttgaacatcgattcccgcaaagaggttgtaaggactaatcccaagcttttcggcgcgttcgtgtgactttttgagtaattcttgactggctaggcgcttcttcgtccaccagaagttaagaaacatcgagtcagcaactggtttcatattggcatcgactagataggactggttttctttggtcaacgcgttttgccaatccattttgccatcctttgtcatcgagtcataccacatcaggtctagcttggagcccgctttttgtttgtattctttgattaactgttgcattagttgggcgtgctttttactcagcccattactagttgagctggttgtggtctttccggttgaagctgaatcaaaacttttaacttcggaatcggtctcttggttgatgaaccagccgtcaaacccgtaagccttagcaaccgcgactagtttatcggccatcggaaaatgcccgtcagcgtcttgttttaagaagtcattgagccattttaacttaccaccactaactacttgcggaaagaaaacggttccaagaacaggcacgccgtttttatgagcagcatcgatgacgtctgcggtcggtggcacaatcaaaccttcgcctgccgaaccgccccagtagacgagttggtcaatatactgccagttggagaagacattcgcatcgaacgtattaatcccgcgaggtgcgttgccactagttgaactattcataatggataacgcgacgaccttcatcttggggtcctgagtcttgttaaccgtcggcagttgccatttatcgatccgtttggctagtggaaccgaggcggtgttgtatttggctactttatccttgctcaactgccatttcagcagttgttttggaaaccagtacggcgcttcgggctgattctccatccccttatcaagggtggcctcagccgtttgacggtaactgatctgctgattagctgactgcttcgaacaagctaccaaacctacagcagtcgtcatcaaagctagtgtgccaacaatgtagcgatattgtccatgtctcatagcgatatcctcctgtgaattaagcaaaatcgacatatccgcgttatgtgagcgatgattgcatgaatcgtaattaagacgtgggcttcgacttaaacctttgaccaccgcgttctggcaattggcagaaatgcctaaaggtcggtggagggcgaacgagctaagcaggtttacgctaagccgaacgctttccagcgggcccaagctgactgcttttgacgttaattattttgcctactttaatcatgattcataacaaattaactagcacaacacgtgaaatacaaaaatttatatattgctggtatgtatgatatcggtttcagtgacagatgagtatagataaaataaaggaatttttccacaaattaaactaattgatagggtcaatcaatttcgatgtaagggggaatactgggtttcaacttgcgcgtaatgtgcgaataggcggggattgttgcggaccgatacaatttagcgaatacgaatttttgcgtgatgaatggcatgtagtataataactagctaggaaggtgattatttattaagtataaagttgataatggtgaatatcctagtggtaaggacgctgtggatcctaagcgagttaaatatctgaaactgattagtaagttagcgacatttacgtgtattgcgatgtacgtgtcgtatattccacaaatcatttcgaatttctcaggtgatccagtgtcgccgctacaaccgctcgtggcaatgattaacgggatattatggactggttatggctggttcaagacctataaggattggcccgtgattatttcaaatgtccccggagtgatttttggcttcatcactgttttaaccgtatatattcattaacctaatgacaaactgactgtaaactaaaagtccgccgatacgtttaatgcgtatcgacggacttttttgcaaggtattaagcgttctttaaagcagcctgagctaacaataggccaccggcaatgccagaattgttacccaatccagcagggacgatgtagtcatccagcggtgggacttcttcgtagccatttagataggcggcaaacttttcacgaatcatggggaagagttgccgttgattcataacaccaccattaagaatgatcttgtccggtgcgaaggcgacggtgaggttgacacatgcctgtgcgatgtagtcagcgatgattggccagaccggatcgttgacgggaatatctttcccagctttccccgttcgttttccaactgctggcccagcagctaaaccttctaaacagatgtcatggtaggggcagctggatttgaaatcgtccccgggtaaccggttgagtcgcatgtgaccaagctcagtatgagtgcgaccattaaaaatgtggttctgactaatgacgccagcgccaacaccggtaccaatcgtcatgtagatgctgttagggacgtccttagcgattccaatcattgattcgccataagcggcttcgttaacatcagtggtccagtagagtgggatgttgaagcgacttttaagatggcctaaaaagtcgaagtcaccccagccgggtttgggagtcgtggtaatgtaaccatatttcggatcatcgggattaacgccgatggggccaaatgaaccgataccaatcgcgtcaacgggatgagtcgtaaaatagtcgtctaccgcagtcatggtttcagcgggggttgtcgtggggatcgaaattcggtcgctaacttgcccgttttcagcgcccgtggcacaaacaaattttgtaccaccagcttcaattgcacctaaaagcatagtgtgcctcctgtagttaaaaatgtagtcttatttattaatagtatactcttaatcagaaattttgttaacgattacattaactttgacgtaaataaattagctgactagtgaaatcagcgttggtgggtttaagtggaattcccatcgtgtttaactgatgccccgtatagcgattacccgatgaatcgctataagttaattcagcatcgagatagtgtaatggtaatgggtgctgagttttgacagcagaattaagcctatttaagtaacagcaaattgcctgctttttatctgccgttactagcaaccacgcaacaacgtgtcttgttgtcggtagacgataaaagtgggccttgataaaagtagacttcagttgctgatatttaatcaaggctcctcgaagaagttgctgttcactaggagcaagttgtttaggattaagttccaatcctagttgcccgatgcaggctaattgtaatcgagtttcaaatggtgttattcggccattttgcgcattgggtgatgcggttatatggttgctgaatatccgtggtggaaatagataactaaatccgttctcgatggttgctcggtcgactggatcagtcaaatcgcttatccacgtctgattggtgtatggtagcataccaaaatcaaaccggccaccaccagctgaacaattttcgataatcagcttggggcaggcacgctttaagcgtgtgagaatatcataaagtccacagacgtagcgataatacagttccccctgttgtgcagccggtaagtgtgtgctgccaacctgtgtaagatggcgattcatatcccatttaaaataatcgagttggttattttgaaccaagttcgtcagagtagtgactaagtggtcacggacagcagcctgcgaaagatctaagactagctggtggcgagctgtgatgggtgtccgatcaacatattgtaatacccagtcaggatgttgttggtagagctggctgttagtggtgatcatttctggttccacccagagaccgaatttcattcgatgatgatgggcttgttgggcaaggggtttcagaccattaggaaacttaatggggtcaacataccagtcacctaattgtccattttcaccgttacggttgacaaaccagccgtcgtctaagacaagcatttgtaagcctaactggtgggcgtgttcgattaagtgttgaactttagactccgaaacggcaaatgtcagtgtttcccaagtgttaagcacacttggaatgttagtctgggagggcatcagctgatagctaaagtcgtgaaatacttgtgacatgccgttaaaaccagtatttgtccaagttagcacggcttcaggagtctgaaaactgctatttggtttgagctgccattcgaatgtatcgggttcaagaccgattgttaggcggctatgttgatattggtcaacttcgacagtactgtcgaagttaccactccatgctagtgcacaaccaataacagtcccagctaattctgtcgtgttaggttctgctagagccatgaacggttggtgttgtggtccactagtgccgcgcagactgcgaaccgtttgtaaccctgggtgtaaacggttaaacgatggattagcttcatgtgcatgggtaccgcttaatgtcagcgcagtatattggtcagttggtagatctagttgagcgctggataggtctgttacttgcaaattagtagtgccgtgatggcgcagagttgtgcttcgcaagataagcggctgattttcaaaaatagtgtagttaagatccatctgtaacttggtcactgaatcggccaaatgaatgactagggttgttacaggcgtgcgtttgctaacggtgggtggcaattggcgcgagttgattggctgatcattcacagaaaaaccagtatattctaaaattggcagtaattgattgttagcatccttaataacgtaagctggctggcgatagtcaccactgccaatagtggaatattcgagtggcagtgaagtcacggaatatggaaagcgttctgttgggtcattagcaaaagcatggctaccggatggcatcggctcaaagtacggttgttttgaaaagtaacgtccaaaatatcgatgcactgggtaacgatgagctaaaatttgaataacatagctaatttggtcattatgaagattgattaagccggttttggggtcatattcaacaggcatgacgtcctcctaataaagtttagacagttgtagcagcaactgagctagctgccggttcagtcaacgcaacgagctgttcaccagcttggacattcgtgactttgagtcgttcaacattagcgtaattggccgtatttgtgacgactagcatgacggttggatcatagttagcggcttttaagacacaaaaaaacgtagtatttcggtgtgggcacggcgaaacgctacgttaatgaagtacaactcggtagtcaccaacgacatgtcgatgttaactaccaaacgatttctcaaaggttatcttaacaccggcgtttcaatcatgcaagcacccgcgctaacctttttgcatcgttaataaactcacatcaacggtaatcttagttaacccctgccgtttagcggttgcgagctgctcagcatccgcaccccagtgcagcggtgtcatgactaataagtcgttaaagtcaatgttatcaagcgcaacttggtattgaattcgttgccgcttagcagtgggatagtgctgggcaaacagatctaacacccgttgattatcatactgatactgtcgatcagtcggtttaaatagtaaatgacgcagttcaactaagtactcaggatttggcacgatcttcaataactgtccaccgggcgcaaggacccgttcaaactcttggtaagcggatggtgagaagacatccataatggccgtgaatgccccatcggtaaagggtaattgggccaaatcggccacacaataataagcagtcgtcgtcaattgggtcgctaagttaaccccatccttactaatgtcaaaaccaatccccacgtcttcagaattggcatgcattgtcaacaaatcagctaggggggtgccttcaccgctaccaatatctaagattcgttgcgccgtttttggcaatgccgcattaatggcttggacaatgggaccgaaaaaaccagcttgcaaaactcggcgccgcgctgccagcatgttagcatcgtactcgctagcgacttgatgcgttagaaaatacaacgtccctttttttgaaaaatctacttgatgcccattaggacaacataagctgtggccgtcaatggtcacgtatgcttgattacaaactaagcatcgaaagcgatcgatatttgcctgaacaaactggatgccgcggtcaatttttttcacaggtgtcaccttaccttggttaattttatcattaggcgtcccatatccaagcgatgctttccagcttacctgaaactatggattcacgatgacaacatcgtgtaaaggacgtatgttcaatcataccatatcggggcggacaaaatagtagctgttacgatttaggtgtggtatcttattaactgttctaaaggctgacttaaattgtcaaaatgaatttgctaccgaatggcatgaatttaatgacataaaggagactcattcagatggcaaagaaatcaaaaattgcgaaagaaaaacgcatcgaagcaaccgtggctaagtatgccgaacgacgccaagcacttaaagctgctggcaactataccgaattggcaaaattaccacgtaatgcttcacccgtgcgtattcatcggcgcgactcacttgacggtcgaccacatgcttacctacgtaagttcggcatgtcgcgccttaactttcgtcgcttagcgcacgctggtcaaattccaggtgttaaaaaagcaagctggtaaagtgacaactggcgtgatattcactaatgattagtaacatcaccattcagttaaattaaaaaggttccacagaattgtcatcagacttctgtggaacctttttaatttggcgttattggtttaatcgcgtttcagcgccatctgagtagccaacaattaccttacttgttagtttgatcagttgatggggttgcttcagcctcatacaatcccgaagaccgtcgataccagtcaaacagatgtgtccacaaaactttcaagatcgcatagcctggaatcccgaaaataacccccatcaacccgaagattttaccagccgctaataggacgactaaaatcgtaatcggatgaatagctaagctactccctaagactaacggtgagataaagcggccttcaatcgtttgttcaatgacgaagacaatcagaacttggaccaacatccatggtgaggtgactaacgcaatgaccactgaaggcaccattgcgagaaaagaccctaaatatggaatcaaatttaagattccagccgcaattcccaacgtcagcgcaaatttcaagccaataatactgtaaccaaccgcaaacatcacggcaacaaagaacgccacggtcaattgaccacgaatataattactgacctgtgaattgatttctgtcaaaacttctaagaatcctgagcgcgctttggtaggcacaaacttagccatatacttcggtagttgatgaccatcgcgcaataggtaaaaaagaataaacggcattgttatcaacccaatgatgacggtcgttacggtactaaatacgcctgtaagtgaagtcaccgtcccggtcaaatacttcgaaaagcggccactcactagcttactgagatccgtgttccaactttcaagttggtcacggatactactgagttgcggatcattgagccagcgattaacttcagtactggcatttttccaataattgggccagtcattgataattgataaagtttgatcgcgaatcgttgggataatcgcaataatgcctaacgccaacagcgcgacaaccacaataaacaaaccaatgatcgtccaggttcgtcgtacgcgaaaacgcttttctagccagtcaacaagtggattaagcaagtagtacagcacaccggccaaaataatcggcaaacccacgatgctaaaaaattgccggactgggtccaatagccaatcgacttgcttgcccataaagaaaatcgtcaatactaataaaataacgaccaagatccgaatgagccgttgtgctgaccaccgtcgcttttgtgaatcaggtttcaagcaatccctccttcctaagcctgatacgtaataacgctaccgaccttgattgttggtaactggtttggcgtcaaataaataccgttttccattggtttggcaggtactggtttgaagtacaacgtcgcgtgcccaattgacgttaaattagcttccactagtccccctgcaaaggccaccgtataagtttgttggtcgattgtaatggtactaccagcaactaacgacagactcgcgatgggctgctcaaatttctgaatcaccgcgatttgctgtaacggcgccgtggccgtttcatcgaataaaactaaaattggttccttggaatcgatggcattcgcaccaatcgattgtactgttgccgttattgtcatattgagacccccatcggttaattaattgctttaattgtagcatagtcctaatcgcagacgccaatttgtcatcgcttacacgtaccatatctatgctatactggaattatctatcaaggaggtttgttatcatgcaagaacgcattttattcggaacttatacgaaaaagacaagccaagggatttacgtaggaacccttgacaccactgccaaaaccctaaccaacgatggcttactggcagccactcaaaatcccacctatttggccctttcagctaaggatcgcctatacagtgtcgataaagaagatgacgagggtggtatcgccgcttggcaaattgacgggcaaactgctcacaaactaaacaccgttgtcgcacctggcaccccaccagcctacgttgctgtcgacgaggcccggcaactcgtctacagtgccaactatcataagggaaccgccgaagtcatgaagattgctgctgatggcgcactaactttgaccgataccgttcgacatagcggccatggccctcgccctgaacaagacggctcccatattcattacactgatctcacaccggatgatcgcttagcggtgattgatctaggtagtgacaaggtctatgtctataacgtcagtgacgacggtcagttaagtgaacaatccgtgctcaagatggaagcgggcttcggaccacgtcacctcgtattcagcccagacggccaatacgccttcttagctggtgaattatcgagtcagattgccagcttaaaatatgatgctcaaactggcgccttcacgcaacttgacattgtgaagaccattcctgccgactacacggcgcataacggtgccgcagccatccgcttgagtcacgacggtcattttctctacgtctccaatcggggctacaacacgttagccgtctttgcagtcgccgctgacggtcatttgaccctgattcagcaaatcagtacggaaggtgacttcccccgtgattttgatttagatccaactgaagcctttgtcgtggtcgttaatcaaaacacggacaatgccactttgtatgcacgcgacttaaccagtggtaaactaagtctattacaaaaggacgttaccgtgcccgaaggcgtttgcgtccgtttctagtaaaggatgaaactcatgttattaaaagaagtctgtgttgaaaattacactaacattcccgcagctattgcggccggtgccaatcggatcgaactcaacgataacctatccgttggcggtacaacggtcagtcgtggtgtaatggctgaggcagccaagtataccggtgaacatcacgtgcccctggtaaccatgattcgcccccgtggtggcaatttcgtttataatgatacggaattaaaaatcatggaagcggacctgctacaggctcaatcattaggcgttgatggtgtcgcattcggtgctttgactgcggataatcagcttgacgaagaagccctagcgttattaattggtgctgccggtggcatgtcgatcaccttccacatggcttttgacgccatccctgaataccaacaagccgcggcaattgactggttagtagaccatgacgtcgatcgtattttgacccatggtggcccacttgaccagccgattgcggactgtgtctcccacttgcaaacgacgatcaaacaggccgcgggtcggattcagatcctgcctggtggtggcatcaccaccgacaatgtcgccgacatcacgaccacactcggtgtcaagcaagcccacgggaccaaaattattaattactaatagctagtaaaaaggcgcatctcgttttttgagatgcgccttttgatttgaaaagtggcctaaaaattgggtcatcaatcactattattcgatgattaactattggcataagcacccgcaccaagccaacttgcccagcctgctgctaacgaactaagccggtcatcgccaacaccgactatttggcaggtgttcataatcaatcatgctaattaagttgaaccgaatgttgccggttcctaatagtcgatcacgaattggcccgttgattatgagtaatcaaacgactaagatcagccggtaacggcgcaaaggtcgtaagcgtctgctcaatgaatggatcatcaaactccagttgcatgcagtgcagtgcttggcgtgtaatccacgggtcacgaggaccgccataaagggcatcgccaatcaacggatgaccctcagcggcaaagtgtactcgaatctgatgcgtccgacccgtatgcaaccgcacccggacgaccgtcatgttacgcaatcgtttaaccacccaatattcggtcaaagacggcttgccatcgggacgggtcgttcgtttgatgaacgaatcagcggcgcgaccaatcggggcatctaaccatccgtgatcagcggctaattcaccgctaacgacggctaagtacatcttgcgcatcgcatgggccttcaattgatgatcaataatcgaatgggcaaagtggtgcttggcgaacagcacgataccactcgtatcgcgatctaaacgcgtcgtaatatgcacgacttcattatcataatgggccttttgataatagccttttacccgattcgctaaggtattgtcaggtaaggcgtgtgctggtactgaggccactcccgctggtttattcacgatcaggtagtcacgatcctcatataaaatatcaatcggcaacgtcgagacccctaagtggtcattaccaatttcagcaggtgtgaccatcgtcaccgtctcaccacccgtcagcatatgaatcgctaatactggttgttcatcaacgagtatcgccccaccatgaaacttgacctttttcaataaactacgggtcacgccatgttgggccaagagagtcttaactttcattggcgtcgtctcgtggttggtccaagtaaacctcattgttcgtccaacccgatgaaggatgtcccgacccgttgccagaagcgattatgacgatgctgtgcaaacgcgattcggcgattagcaattgaataacgaatttgttcaatcggccgcggttgcgtatccatttgatcagccgtgaagacaaagtgcgactgctgttgcggtcgaatcgtaatcgtttcatacggcgccacgatgactggtgatcctaacgtccggaaaacccggttattgatcgatgcgatttcggccatctgtaaagcgtccaatcgcggatgaatgactgcaccacccacggatttattataagccgttgaaccagttggcgtcgaaacgcataacccatcgccacggaatcgttcgaataattcatcttgaatataaacatccgcgaccatggtactccctagctttttgagcgttgactcgttcagcgccaggtaatgatcagttgcatcagtatccgcataagtaatatccaccgctagcaagggataagtcacgctctgaccgttgtcttccagtagcccggtaatcagttggtcgatctcataatcgcgccagtccgtatagaagcctaaatggccagtatgcacgccgacaaagcgaacctggtcaaccatgtgacgatagtgatgaaacgccgctaagagcgtcccatcgccccctaccgacaagacaatgtcagggtgcacatcatcaatttcaaacccagccgctagcaactttgagtgtaactcactcgcaacctttttggtcttagcactctcattggcaaaaatcgttactttcatgaattctgatcttcctttgtcgtgtcaggatcatcattgcccggccccttcccgtatgagaacaggctctgagcttcttgaatctcctcacgaatttctgacatttctttatccaaactaaaggcagcttccgcagcccgctgtaatcgttgactcaagttttcggggaaatccccttgatatttatagttaagcgaatgttcaatggtcgcccagaaattcatggcaagcgtccggacttgaatttcagccaggatttttttctcaccaccgaccatttgaactggatattcaatcacgatatgatatgaccgataaccagagggcttttcgttactaatatagtcacgttcttctaagatcgtcatatcggtccgtttgcgcaataagtcaacgacctgatagatatcttcaacgaactgacacataatccgcagaccagcgatgtcctgcatatcttgttccaagcgatcctcttgtaccttacgtcgggtcatcttttccttaatgctatcaacgggcttgacccgccccgttacaaattcaatcggttcatgctgattcaaatcacgaaattgtttgcgcattccccgcagtttaaccttaagctcatcaacggcttgttgataaggcagtaaaaaatgattccaatcttccatcggggcacctccgtttcaatccataccctaaaattttaccataaatcgccggaataaaaagttaacgttctcgagattgaaccctaagttcacttttttccaaactgtaatcctaggaacaaaatactttacgaatttagcaaatcggttcatgattacgggtgaaggttcaattcaagtaacgagtggtgctcggcacaaaaaattcatgaaagcaaaaacttgcaaatacctcgtttgattggtattctgcactatgacgcgaacagagaaagtggaggaattatgacgtgttagaagtgtatttatttgtaaatccgttggcaaaccaatgcgtacgcgatgaacaaaacgtgttacggttggcaaatgactcagacaagcaaatccaatttcaattcgtaccgttactcaatattaatgttatccaacgggcgttaaagtgccagggcattcaagcatccgattggcacgctcaaaaccaacaatcacaaacattatatcgggttatcctagattataaggccgctctttttcagggtaaaaaacgtggccgcaactttttgattgccctacagtccgcgatgctaaaagcgggtcagcattattctgaatcacttgttaaaacagttgcgactgactgtcagattgatctggacatgttcatggaagatcgtgacagtgatttagcgaaacaagcttttcatgctgatcaacgcttagcatccgagatgaatattaccgaggcatcatctgctgtcgtctttgactgtgatcaatatgattacggcgtcttattagagcaattcaattacacgaccttgtttgatttggtcaatggcaacttggatccatttcaggatgctacgcgcgcaactaatgctagttgtgctaatctttccaatgcacaattacacgttttataatttcagtaattgcaattattcaactggtctaccagtcaaaagcacccgacgatcattttcgccgggtgcttttgactatgttcactttttatactggctgggaacagccccttttaacgtaccgactccccaaccgttttggatcaaaatgaacgtcagaatcagacatctgacgttcattttacgttgtttcatcaggtttattttcgggtgaccagttgttcgaactcgtctagccgttcttcaaataccttaaaggctgcgtccaaataatctgacttagtcatgtcaacccctgcgcgatgcatgacatcgattgggaacgctgatgaaccggctttcaaatagccgaggtaatcatcaacggcaccaggctgtttcgtactgatacggtcggctagcgtggatgccgctgcgaagcccgtagcgtattgataaacataataattgtaatagaagtgtggaatccgagaccattcatcagcaatttgtggatcactgacgacggcatcaccatagtaacgttggttcaactgtaaataatattttgataagcgatccgcagtcaaggcctgcccttcttgatcctgttcatggagccactgttcgaactcagcgaagtgggtctgccggaaaacagtgcccttaaagccatccaagtagtagttcaagacgtacgctcgcattttagggtcttgttcagttgctaggaaatagttcgtcaataagttttcattagttgttgacgcaatttccgccacaaaaattgaataatccccatattgataaggttgatgatgcgtcgtgaagtatgagtgcatactgtgtcccatttcatgcaccaacgtgtataaattatcaatattatcctgccagttcaacagcatatacggcgcagtatcatacattccagacgaatatgccccgctacgtttgccttggttttccaccacatcgatccaccgcgaagcaaacgctgttttgacgtgtttcagataatcaggtcccaaaattttgagggcttgtaaggcagtcgattgggcctgttgataggtataattggtcgtcggcttaggtgccaaaggcgtatacatatcatacatgtgcaactgatcaacaccaagcaactgctttcgtaaggcaacgtaacggtgtaacagatctaagtgcttgtcaacagacgtgactaaagaatcatagaccgctgtcggaatctgattggccgcaagtgccgccgttcgcgcatccggatagtggtgagccgtagcgacgaaattatgcaccttgacttggctagctaacgtcgacgcgagcgtccgtcgaaattgcccatacactttatatagcgcctcaaatgcctcacgccgaacggccggatgaacggactcaagcagcacgccataaatgccttgcgacaatttgacagggttaccgtcgtcatccttcaccgtcggaaattgaaagtcagcgttattcaacacaccaaaagtcttcgcggaagccccaaaaatatcgccagctccggcaagtaaggcttcctcgttctcagatagaacgtggcccttttgtaagcgaaccgtatccaacaagtgccggtaatcacgtaaatcgacgttttcatcaagatacgtatctaattcgcccggcgttaattccaagattgccggttcaaaccaggcagttgctgcggacactttggcggtcaaactactagcctggtcatccaaagcagcgttggtactattaccagtatcctgatcacttttcaaactcgcatagaccgccaccttctctaggcgacgatacaaagctaaaacggcctgaatgcctgccaacaccgtgtcggccgagcttgtaaaatcttctttgagcgcactaacggtggggattgccgctttaacttgtgcaacatccgcctcatatgcagcctgatcagcataaatcggtgtcaaatcccatgtcaattcttcaggaacagccgaccgggtcggcaattgtttggttgctaccatgcagattcctccaattatttcaatatagcactagattaccacagtttgcggccatcacggtagcatctgttctgaaattaccccttgccccatctaagctgttgagaattcacctgccaatcagtcccccgttgaattagcacttgctgttcgccaagcgtcacgatcatagccgcaatcagttgttgcgctaattgcccccgtgattgcaaacaggctcgccgagcaagtaacggtcgtaattggtcccaaagtaacgcctttatttggggtccagtcaaacatcccggccgttgccgcaacgcaaaaaagacgtgagcatgccagaccaagtatggcactgacaacagtggtacctggggcgtggtcggcatggtccaactggggagttgggcaatcgtccccccacgttgatagcaatctgcttgtaatacatcaaaaccacgttgatgtcggagacgagccaccagcagctgttgatagtaacgctgcaaatgagcacttggcaaagtgggactactcattttaggcgtcaattgctgtaaactcaacaccgattggctacgagtatccagccgactcgtctggtacgtcaaaggctccgcatccaatgtcaagatgtggtgcaataaacggacgctggcactctgcacgtctaaaaaaagtaaaaacgtcccccaccgttgttgatactgcaaaaactttaaggccttactgttgaggtgcaactggcgctgataggggcggcccagcaaccataacacctgatagccatgctgccgatagccttgtgttcgagcagcgagccgtgccacagacaggggcgaacactgaaactctagggccagcggttgtgccgttccccgttgcaccaaaatatccggtcgctgatgtaagtccggcaacccagcttctaaacgcaccgtatagccactagtcgcaaaccaagtcgctaattgttgtttaccgcgaagatgttccgttgattcaccttcagaaaaggcgtcacaatccgttgcatggacgtgggcaaagtgtggcacgaccaccgccccgcgtttcagtcggacaggctgcacacatcctggacagtgatagtcgctttggcgatcagcggttgccgcattgacgagctgatgctgagcatccatggcaatcaacatgctactccccctcccttcaacaactatttacgtcgttggtcgtaattctcacgaaagcaccgccctttattacaccgagctgcccacttttggggagaaagcgcaggtgtccatgagcgcacaaaaaaagccttaacatcacgaatacacgttatgttgaggcaattaactttactatttaaaatagtggcgaacggtttccaaagcggcgttggacataatcttttcaccatgttcaagcaatacatcggctgaaatattagctaaatgcgcatattccagagcaacggcgacatcgtccttgatggttgccgttgatgattggtcaacaaagaaaaccagttccagataatattgatcccgatacttaaataagttagatgcgagtccttctggccggaataattgtgccaatgaaacgaaatcctcaaactgatcgaatttcaacacgtattccttagttggcgtgtcagggtcgtccaaatatggatcaaggtcattcgtgtccttagttggattgtgtgcgacaccctgcccatcttcaacttggttcgtgtctgtctgcattagtttgcgcttcaaataatccgaaacatcatcttgtgaatcgtcgtccgattggtcgggcgactgggttgccttagcaatcgtatcctgtaaattatcactatttttgctaataaataattctaagccgtttcggttcggtaatacttggaaagttacggcatcattgtcctgaaattgatgatcaacatcaacttcctccaagatgctatagaaaaaattttcaatttgcttatgattccctagtaaatctagtacgcgaataccgcgttcattgagatcatcatttccaataacgacgcgaatcgtatcttcgttgatgcgttccatctccattacagatccacccctttctaagtgtcaagggccataatcactatcacaattctaacttatttcagtttattgtaaagtaatctatctgaaaatacaaaaattggccaattagttaagctaactagccaataataattacatgtttgctaattgttgtgcccgcaataattctaacgtccgaatcttacgtggcaagaagcgccgaatttcatcctcattataaccaacttggagacgcttctcatctagcataattggtcgtcgcaatagactgggatcatgagtaatcatgtcaaacaactcgttgagtgacaaatcattaatatcaacgttcagctgctgaaaggccttcgagcgagtagaaataatttcttccgtccctgattcagtcagctgtaagatttgcttaattttttcaattgaaagcggttcggtaaacagattgtgttcttgaaaatcaatgtcgtgtgtctgtaaccaagccttggctttgcgacatgaggtacaacttggtgcggtatataaaataaccatcctgggtcctccttggcatcgttaatcaattttataacataattcattatacgctaaccacttttaattgtgaataggtttaacaaaattaattaatttaaaactaataaactaaaatacgattattaaacatttgtattttttctattcaataaaccgcttttataacgacacgtgttattaactaactcgtatacaattcattttcgacttatgatatcaataacctatttacggtaaactgacagaaaaagcttagcaaaacgatttgctaagccctatcatactaatcaagatttaattgtaaaaacttttgggcgaccatgacttgaatgtcattaccggcggctgcttgtgcttcttgttgcagttgtgtaaatgaaacatcttgtggcaagtgtgtgagcaataatttttgcacgtgggcatccttagcaatcttgccagactgcgccgacgtcatatgccacatcttcccagtcttatcggcgccaaaattcgtgtcggtcatcaataattgtgctccagctgcaaaggtcgcgagttccggcaagtaagctgtatcagcagaaaagacgagctcttgccccgtcgcctgctcgaccaatttaaccgcataggccggaactggatgtttagtcggtaaaaagctaacatcaaacgggccaatttgattgacgacagccggatcgtaagcacgcccttccgtagcgttcggccaggtcaacgcaccaaagttaagtggatcagcggtgtgcccatagatcggtaacacgggcgtcttacgttcgccaggacgtagttgccaataatattgtaagaccccgacatccgctgtatgatcatgatgatagtgtgttagaagcacactatcgagctgtaaggggtctaaaatctcctctaatgcatttagcgcgcctgacccacaatcgagtaacaagtggtaatcaccggctgtaattaggtaagaactcgtccccacgccatcatatgggtaaccaccatagtacccaagaactgttagtttcattattgaccatcccttcatttttaagtccgcttctattttaatatagcagctaggaaaaatgaaaccaacaacttaacatattttcaattattttgaaaaacacgtataataatagatgtaataaataaggagtgatattgatgagtggaaagattgcagcaacatttggaacgcgtaaaattctaaccatgatccaacaacaaaatgctgatcgcgacttgcttttaatgcaggccaatgccactgaagatcgctatatgctactcgatttaaccggcgaaaagaccgttttttcaagcccagtaacgtatgacgttttactttcaaagggatcagctgactggcatgggatgacaagttttatcttcgttgatttaccggaagatgaacaaaaagtctttaagtctaagtttagtagtttccgccatgactataataagccagatggtctcaaacatttttggattttacgtgagtccaaaaataattcagccttcgtgatcgttacaaattggcacagtgattctgaatatgcggtttggctgcggagtgcttcattcaaaccatttgcgaagtacatcacctcagattatggctaccacgaaagccgttactcatttgtacggtcattaaaatcataatcagccgttattggctaattcaagtcgttgcagtttagctgcaacgactttttttgacgaatacgtttacgctgggcacaccagccttggcaactcgcaatcaaacatcgcttctaataccacattgcagccacgagtggtcacgtatgcagctggcgtggttcttaagcgagtaacgtcattggttagttgattttaaactatccgtcttctaaccggtggcattaccaggcatcgcgaataaaatcaccgttaccatccgttcgttagtatctttcgccaagatacacagcaagaaacgctcgcgcatttcgcggaagattcctagtggcccgtacgtcgcttacaccgatttctatgagtctcaagtctgttgtccctaataccagtaaatcgtaccgtgccgaatgttaaaagatagcgtgtcgccttgaccagccagcatggctatgccgatcggctaaaactaatggcaacaccacccaaataccaacaactgatcctttatgacatctagcgtcaacagtcaattgcttaaccaagcagaacaatttgaatcactaccccgcccacttagctcgccgtttaccttatcgacaatttcgacgaacatctgcacgattctggagacacaaaaaaacgccattcatcagcgaatgacgtatgtgattatttaacttttaacaggaatcatagtttaccatttataatcaattgggtcccgtaagccccggccagtcgctttgtccaacataatgcgttgttcaaagtgcgccacatttcgtttagtctccttgaccatatccggattgactgaaacatagtcgatgccgctttgaatcaggaagttagtaaactcggggtactctgatggtgcttgaccacaaatcgaaaccgtcttgccatctttatgcgccgtcttaatcaagtgccgaatcgcccgtttaacggccaagttccgctcatcaaagaggtgagccaccgtatcattgttacgatcacaacccagaatcaacattgcaaggtcattcgaaccgatcgaatagccatcaacgaattgattgaattggtcggccaaaataatgttggttgggatttcagccatcatatagactttgaagtcagcactccgagctaggccttcatcgcgcataatggtcgttactttttgtgcttcgtcaacagttcgtacgaatggaatcatgacatttaaattcttcaacccaaattcgttccgaactttcttgaccgcagccagttccaacttgaaggcctcgatatacttggaatcatagtaccgagatgcaccccgccaacccagtaaatcagctggttcatgcggctcgtatttgtcgccaccctttagattacgatattcgctcgacttaaagtctgagaagcgtaggacgactggccgtggtgccattgcccgaacaaccttcgcgataccatccgccagcatattgaccaccttttcaggatgaccctgctcgatcaagtatagtggatgttcatgaataaaggttgtccataggaactcttcgcgcattaagccgattccatcagctggtaaacttgaatatttgtcagccaaatcaggatcacccaaattcatcatcacgcccgtagcagttggagcaaagctctcggccgcaaccacctgaccagcaaccgccgtagcaccactctttggcttcaacatgctagcgactttaccttgataaacaaccccgttcttagcatcgaccgtgacgacatcgccggtcttcaagacgtcggttgccgcggcttccttacttttagtgccgacaatacatggaatctgcatctcacgagaaacaatcgctgcatgacaagtcatcccaccgttattagtcacaatggccgcggctttcttcattgccggtacccaatctggtgacgtcattaacgtcactaacacttcaccttgcttgaattgatcaatgtccttcgggttatcaatgacgtgaacaacgccactagctaagcctggactggctggtaacccccggacaacgactttagcatccgcttcatccacaacatcttcgtcgtcagctgcatccttgtgtttattgcgctgtgaccaaaccgtttctggccgtgcttgcacgatccatagccgattggtattcgtgtccaaagcgtattccatgtccatgtagcaaccgtaatgccgttcgatttctttagcgtagcccgccaattcgataacttgtgcatccgttaatactggttgtccctgtaattcatcgggaaccggctcttccttggtcccgccacccggtaaccgcatcagttggacgggttgtttaataatattcttttcaacgattttcatggactgtttatcgataacaaagtgatccggcgtcactttgcccaagacaatgtattcgcccaaaccataaatagcatcaatcacgatcttagaagcatccccatccgccacgttgacggagaacatgatcccagaagctttagaaaagaccatcatttgaattgcagctgaaagcgccactttttcgtgtgggaagtgttgcttgtgccgataatacgtcgcccgatcggtgaacagcgatgagtaacattgttgaacccggttaacgacatcggcggcacccttaatatttaagtaagattcttgttggccggcaaatgaagcgtttggcaagtcttccgcagtcgctgaagaacgaatcgccacgaacggatcagtttggcccatcttcttggctagatctgcataggcttgttcaatatcagctgccaaatcagcgggcatcgtcgctcccacaatcaaattacggatttgttcgcacgcggtatgcaattcatcagaattttcataatcctgaatgctggccaacaaatcattgaccttataattcaatcccgtctggttcatgaagtactgatacgcccgggcggtggtcgcaaagccatatggtaccggaacatccatcgatgacgtcatttcacctagtgaggacgatttgccacccaccaggtttacatcttcgcggtgtaattcatcaaaccataaaacgtttgccgtatcacgactactcataagattacctccctgtgtttcttcacttgaatatcatcattatcaaacttaagttaagttctgtaagcgtttacattaaccatttatattgtagttcatttttacacaaagtaaaacccattttcattattttcttggcaaaatatagttgtatacgttgattgatcacgcccgttaaagttcagctccggcgtgaaagaaaaggcatttaacggggacatattttcaaattaactcggattctaattgccaactgtaaggccaactaattaacgaacttatttcacaatatgcgaaatcaactcattccagacggtgcaacccagtgtttatccccaaaacacaaagtagccagcggcgattactttcatcaccactagctacttttagcgtctatcactatgacttaagtctaaatcgatatttcactaatccgtaagcacttcaactggcagctgcattcctttccagccttccagcgctcctgctaattcatacgcatcaaagcctgcggatagtagcacgagtagcgccgtttgccgagggttgtcccacccgtccaatcgtacacgacataggtcttcgccggatccagttcactgattctggttgccagatccttggcgggcatcgcgattgcacccttgatttgatctttcttcacttgggccggtgcattccgaacatctaagacgacgtacttgcccgtcgcattttgcatatcggctaaaacggtgtgatgatcgatgtataagcttaaatatgttgttaacaattcaattttcttgtcattcatgattaattgcctcactttttaagtgttgggtcccctgcttgattttatccattaaatctttaaactgctgctgctcttcaatcgtaaacgacgcaaaaattgtcgtaaccgccttaaaattggccggtaaaaattgcgtcaatacacgactaccggcggcggtcaaatgaatggcaaccgtccgcttatcatcttgtggatgctgcttttccacccagcctcgcttttgcaaaccgaccagtaacttgctcacagtcgcccgcgcagatcctagctttgtggctaactccgatggcaatagcgtgtgatcagtttcattttccagcaacatcaaaataataaacttagattctgaaagttgatattgatcgagtaattgttcataggtggcttgcatggttcgaaatgtccactgaaaatccagaaaggccaaaacctgctcagcatccgccgagctactcgctttgtccagcgtcaattgcacacgctgtttatctggtcgatcacgaaacggaaagtcaggcattgaaatccttctttctaaaactaattagccggctaactacttttagaagtatacacgctttttcatcatcgtcaacccttgaattggactagccgtcattcaaaacactcaccatccaaataaccctagccatcaagcaccacgacattcttcgttcaaactgatgccgattgaaatcaatagattagcgtgcgcaactcaacggaaagcaagcaatcagttgtcaacattcaatattcagatactgagcaggcaccgaccattgaacggggccgcgctttcactgatactagcgccaaggccacgcctaaacacgtcaacgtagcgagtttgaatggtacctggattgctgccgaaactacgacatacaggcaagttgctgatcaaagatgacgacctatatcaacatcgttatgatagttatgaacgagctgctatccaggacctcagccactactcattaggctcactgaatcaaaacgtgacctatgcggctttcaaaaccgatacagcccacgctggctatcaattaacccataccgccgttgccagtggtgatagtaccggtatgttatctctcatcatcaacgcgaataaaatcatccgtatcaatcagcagattgttacgacctatacgaaaaccagtgccgtcgtcgctgctaacgacctaccgaaaacagccgttgatttatttaagcgaatggatcaaaaaaaggctggtgaagtcgccacgacgattacggtaaaggccggtcccgcgcagattggcatgaccaatagtattaactacctaaccgaccccgatgctggtcaaatcacagagacaatcgtgatcaactaacagccggagtgcttcatttgaaaaaggatcagggcgccacttatcaaaaacgacacttcataaagcacgtagcaaaggccctgttgaactacttctcatatcaaaataagcacgttgtaaaaccacgttctggtgatttttacaacgtgcttattttgtcatcgaacacctgcaccgtatccaccgtatcagtaattttatgcttaacacagtaacacaatttcacgacacctcaggccgattcagaaagtgatctggtcaactgacatcccagtatgacacaacacgtcaattgtcccgctttaatcgtgcagagtacgactaattgcaaggttagcccctaatcatgctcgtattcacgttttagtcgcatccatcctgcatgcagaccaaaagccgttgtaaaggacaataaccaggtcaaaccataacacagcgcaatgctcggccagggagccttgaccatcaaagtacgaccaaaaccgcgccacaacaattcagaccagaaaacattcgctaagtatgccttataggccataccagcaaagaaatgtacaaatttgctaacaggccgttgatgacgaacttgaatctcacacaacgccgccaacaggccgatgactgctagcgcataccccgtcattgatggtttgtaatacggggcgttgcgcaaattaaccgggaagccgtaactgaacagttcccaattagtccagatcaggccaactaaccatagaccaagtaatcccggccaccacttgttaagcatgcgctgaaaggtatctcgaaacacccaagctaacatgccatagaacccgaaaatctggaaactgataaaaagccggtccagtaaataccaatcacggctgtgaggaccatggaaaacttgttggtcataaaaccacaaccaaagaacggcgaccagtgttgtaccgccaaatacgatccagccgcgtcgaggtcgagactgacaccaacggccaagcgcccagaataacggcattaatatgataaattgtagcatcatggtgttataccacagatgaggcgctgcattaccattaacgaactgccataaaaatccccgccagtcatgatattggctaccttgctgcaattgtggcatcaagattaagtagatcgcggtccaccaaatcgtcggaataaacagcgcatgccactgctggtgcaaatagttggtataggtcaacgcggtctgattaagcgtcaagcgcgtcgtcgtatagagaataccaaaaataaaggccggtgccgtatacttgaccagattataaacaacaccaatcccagtttgcgtggcaatcgacggcccacttgccaatgcgtctgtgagaattggctgggccatcaccgcagtacaggcccctagtttgaggtaatcgccaacgtcagtgaccgccatcgacggactagaaatcatcgtcacttgctaccacctcttcgaattgttaccagatcaaccggtggtcaaccttaaacccagtctaatagattcccatgggattacaagtacacttcgcgaacattaccagctgatgattgtattctttgatacgattccaactaccttacctttcaagcaagccatacactttaagggaccatctaggcaaaaaaatcgcgtcagaccggtcagcattagccgatttacggtcagacacaatcgtgatttctttataaatttcaatctggtggtctaagcccaacctgcaaatacctgactgagcagtagccaaccaccagattactcagcgttttggtccaacaacacaatgacctttccaaaactgtctgccgcttgcaaataagcatgggccgccggtacctgatcaaagttaaaaatccgagcaggggcgaccgacacatgatatgctgcgatgaagtcaaataaatcttgcaacaatgtctgagaaacatcgccagaggaaaagcccgttaaataacacccattcggaatatcactgatcgggtcaaaatcagggacggtccacagcccacctaattcgcccgtcatatttacaatgccgccttcgttgagatgcgacaacgaatctttgacactgagtggaccaatcaagtcgataattttatcaaaatgagccgttgcggctggtaaacgagcgctatccggagcgacaatgacctcatcaaagccagcgtcaattaattgttgccgcttaactagccgccgagtagtcccggccacatggatcttcggattataagccttgatcagatttaaatcagcaatcccaaccccactagtagctgctcgaattagcacccggtccgtcgctttaagctgcaaagacttaaaaatgccataggccgtgtagtaggtctcaggggtggccaccaatgaagccatcggtagatccgttttgatcggataaacctgctcgttcggtaataatacgtattcggcataactaccatcatatgcccgacccatctcgcccatgattgaaaccacacgttgcccagacgtgaacgttgctggtgcactggtctcatcgaccaccccaactacttcgattccgagcactcgtgggaactgcacgctcggtgacttgccttcccgcgtaaagatttctgagtgattgataccaaaacctaaaacttttacccgggtccaccccggtttaacgctcggtttaggaagcgtcgttaattgtaacgtttctggtccacctggttggttcacgacgtatgctttcataataattgtgctcctttatcgattagtttaataaatggtgggctttcaaatatgcttttgcaaccatcgccgcctttttatgttgcatggtaacctgataattcatattttgcatatcagatgttgaaatcttgcctgatagtttcttcaaagacttaacaatttgtggatgttgtgtcataaaccgctgcttcattaaaggtgctccctggtacggcgggaagaaatgtttattatccttcaataggactagatgatacttcttagcggttgcctgagtaactgtaattccataaccattttgataactcatcggttttagataggctaattggtactgccgtaacaatgctcgtttagccgtctgataagtcacatttggatttgaattaagcgccgcctgccctttactaaagattgtaacaccgttccagtaattcccccaaaagttgagtaccatctctcggatatcggtgaaagcatgcggcccatcatcaattcaatggccgattggggcagtgactatttggataatcaccctgacaaacgcaaagttattatgtaaaaaaggcaatatcaattttaaaaaagctccttctatgacaacatcagaacttggttgtcatagaaggagtttttttatcgttgaccagtttgacgcgtcttcattgccaatatcatggttcccaattcaattaacactaaaatcagcaataaccccaacgccatggttgaccctaacgctgtccgatgcgcactagttccagtcgtctgtacttgaactaacgtgataacggcggacacgactgaagtcccaatggcccctgcaaactgctgcatggtattgaacacggcattgccatcagcttgatgctcagctgacaactgctgtaagccactcgtcatcgtattacccatggttaagccaataccaatcattaataaaatgtaaatggctaaaatcaaaccgcctgacaggtgcatccccaacaccgtaaacagtgccatggcaataaccaaaattgttgaacccgtgaggactggtttagctgcacccagactgtctagaatccgtccacctagtggggcaaaaacagccccgatcgccgcgccaggtagtacaaacaagccagctaacaaagcactcttgccgttcactaactggatgtagttgggcaagatgaaggccaacccgagggcgcagatttgaaccaaaaagtacgccattaagtgcaaatcataagattttgtggtaaaaatcgccagattgattagcggttgtgccgctcgacgtgtgcggataacgaaccccacaaggccaatcaggccgaccaccagccaagccacaaaaatcagtggttgcgtggtaatcgtggctaacttgctgaatccaattgtaaagccaacgaataagaggacaatcatcagccaaccgaccacatcaaacccgactttaacggtcggctgggcctggcgaatcgcatataatcctaacgcgagcgaaagcacgagtaccgggatcagcatgatgaaaatccaatgccaatccatccgactaacgatcaggcccccaaaggtcggccccagtgctggggcaattgcggtaatcagcgtaccgattcccatcaaggtccctttctgccgcacgggcgcccaatcaataataatattaaacattagcggtaaggcgattccagtccccaacccttgaatgattcgtccagtgactaaaacgggaaagctggtcgcagtcgcgtccacgaccagtcccagaataaatagtaagttggccgtcacaaataatgtcttagtccgaaagcggcgtttcaaaaacgccgaaatcggcacgataattgcgactactaacaagtaagccgtggtcatccactggaccgtcgccgtattgagtgcaaattctcgcatcaacttaggaaaagtgatattcatcgcagtctccacgatcaccccgcaaaatgaaagtaatccggcagccacgattgcaagaatcaatttgaggtcaacgcgtttttccatacttaaaatcagctccttaataatagttcgaacacgaactagttatctattttaacatattgtttcaatatttaaagccataattcggttgactttgaggcaattagttcttataattcaatctagttagaaagctaaccatagtattactaaggagcctactcatgcaagattcattaggaatcatgattaaaaaagcgaacaacgcgctatccagagactcagaccattttgcaaaatcactgggactaactggcatgcaaattagtgcaatcaactttatcgccaataatgaacaacatcacgacctcttccaacgggacttagaattagagttcaacattcgtaaagcgacctgttccagcctcgtttccaaaatggaagccgctgatctactcattcgcgtgccggcgaaagacgatggtcgctacaaacgactactcctaacacccaaggcccgccaattagccaccaagatcgaacgcttctttgaagccagtgaacagcgaatggccacgattttaggagcaagcaccgccgaaacttacgaagccctgcgacaaatcaccgtcgccttttcaaccccgacccatgcacctgaaaattggtactaaccgttcaaagacccgctgacagtcactgactgccagcgggtctttgattttacgctcattactcagccaagaagcgtgtaaacagctgttggtaaatggcaataaagtcataaaacatctgctttggtaagctttcattgacctgatgttgggtcatgttacctggcccataaaccgcaaagggaaaatcagccggttgacgcttagccaaattggaagcatcggtaattcccggacttgaggcgacgacaacatcgcgaccagcatagggcttgccaacggcctgcactaactttactaaccgattatcagccgtggttgcaattggtgactcattcatgatagcggtcatcttaatgtcagcaccttgctgattatacgctgcaatcaggtccgttaatttttgggtcacttggtcattatcgtattccggaatcgtccgcacattaacgagtgcagtcgctaaatcgggtaacgaatttacttggtccccaccgtttaacacgtcaatgttaaatctgaccggtcccatctcgcctgccggaatcgtttcaaaatagtcattggcttcattgagtaatttaatcagcgggactaaagcattatagccgcgttcgggtgtcgaactgtgtaccgccttacccttagacgtcaattttaagtcataagaccccttctgctcagccgctgttccataaaccgttgaaggttcagcaatcagtaaaccagctgcatcttgcatcgccccttgttgataaaaggcagctgagccagcttcaccaacttcttcgcccattgtcgccaacaagcgaatggtgccatgtttagggccaccttgctgctgaatattgatcatcgcagcgactaatgcgactaaaccagccttcatatccgtgacgccccgaccaaataactgaccggatttttctactaaggtgaaaggatcggtgtcccacgccgccaggtcacctgccgcaaccacatccatatgaccggaaaccgctaaaacaggctgcccatgaccaatctctgcaactagatttgcacgatcaccggtaatggggtaaatcttagctgaaatatcatacttcgccaacagggcttgcaaatattttgcgaccgtcaactcatggtcgttaactgatggaatcttaatcacatccgctagaatcttaagcgctgcatcgtcttcaatcgttcgcatattttgccaccaactttcttatgataatttcagtctaacacttctgaaccttctattttacccaatagcctctgctacgttatcaaattttgttgaaattaatatcttagttatcaatcatcatgttcgtgtcaaaattgaggttcgacccgttgttcgatcattaaaatattcatactgaactagttccgcatacgccccagcaatgttgaccacattcgtatagccgcgctgaagtaacgcgcggaccatattgtaacttcgctgtccggtctgacaatgaatataaactggctgattggtcggaatttccactaagcgctgccgaaactgactcagcggaatattatgagcgcccttgatgtgcccatcagcgtactcttgtggttcacgggcatcgatgataaacgcccccgccaagaccagctgtcgaacctgcgtcaccgcaacctgcttaaattcatcattcaggacgttttccgccactaagccaaccatgttgacgacatttttggcggtactgacccatggcgagtaacataattcaacatctgtcaggtcactgactcgaccgtgcatcgtgattagactagcgataatatcaatcggtttgtcaacgtccgattgaccaatggcctgtgcgcccaaaatctcaccggtcggataactgaatatcaacttaagaaagacggctgttgtccccggcatcacgctgacccgattctgtggtgccaccgttgcgaaccgataatcaagttgctggtgctcacactcagtagcgttcaggcccgttgacgccacgtttaacgtaaagacgtgaagaacctgcgatccgatcacaccctgataatgtggcgtccgcccgtataaatgatccaccatgtgtcgggcctgcatttgtgctggaaatgccaatgctagccgcgtagattgacgcgtaagccgattagtcacttcaatggcatcacccaccgcataaatgtcggccacggacgtctggtaacgatgatcaaccttgataccaccggtcacgcctaacgcacaacccgcttgaaccgctaattcagttactggtgtaaccccaattgccacaatcactaactggctggtcacggcgcgtcccgaggcgagctgcacttgtgttgcaccaatggccgtcacttgttcttgcagtatcacctgcacaccgtgatcgtatagttccttgtgtactagctgagcaaactcgtcatccaaagtgcccaagacgtgctcggcagcctcaatgattgtgatctgatagccagcctgttgtaaattttcagccatctctagtccgataaagccgccgccaacaatcgtcacatcatgaacgtgttgttcagtcagatacgcttgaatcgttcggacatcttgaacattgcggaccgttttaacattgggccggtcgattcccgcaatcactgcgggtagtatcggtcgagcaccaggtgaaagaatcagtgtatcatatgggacgatcgtcgttgctacctgtccttgccgtttgatcatcactgtcttagcctgcgcatcaatggcgacaaccgttgtattcacttgaacgtcaatattgtactgttgctcgaattgcatcggtgtctttaaaatcacgtcatcgggctggtcaatcacatcactgaatgtgtacggtaaggcacaattggaaaatgagacatccggccccctttcaaaaattgtaatctgggcgaactcgtccaatcgacgcacgcgggccgccgctgaagcaccaccaccaacgccaccaacaatgaccacttttttcactttcatctgaaccatcctttcgtaggtatgctgtagccctgccactaattagcttaattttaagggtttcaaggcgtaaccacaacatcaacgccgattaattcaaccgttttcattaattgacgtcattggctttctatttaagctaaaataagttagtatgtgtttaacacttaaaaaagcttaaggtgatcaattatgaaccaaaaaacacgcttaacattgattcttgatgaattaaaaaaccacccatcactgagtttaaaagacattatgcaattaacggggacttcacgcgacactgcccggcgcgatattgtcaaactcgcagctcataatttggctgaacgaaactacggcggcattagtcggccgaatacgtttaataagctggatcagtacctggaccgggatgatgacttactgcaaactaaacgagccctggcccacactgccagttcgtatttactaaatgatgcgttattatttctagatatctcaaccaccgttgcctgtctaccacaatatctccagtccaagcaccccggcatgatcgttacgaattcccttgacattgctgaccaggcattacgacatagcaattttcaaacgcgtatcctgggtggcacattagatgcacaacaacggtgtgttcaaggcgctgacagcattctagcactacacaaatttcgatttacgaccacggccttgagttgcgctgggttgaccgcagacggcgtttattacgcttacgaatctgatatcgctttaaaggaaacgttacgcgcccaaagcgaccggctagtgctgttgtttgaccacaccaaggtgaacgtcagccacaacttcaacttgctagctctcagtgattttgattactttgtgactgatcagccactaccggataacctagctactaaaattgcacctgataaacttatttacctttagaggaggatcattaacatgccatcttcactattaactactcaacgagcaatgttagccctgattcaaagcggattagcctacacgactgacccgttcgacaaagatcgctatcaaaagttacaaaccttattgattcaacaaatggccgccgctgccaacgtcgccactgctgacctgacggctgctctaactcaggactctggctacattacccccaaaatcgacgttcgcggcttgatacgccatggtaatcagctactactcgttcaagatattaaaacgaaactatgggccttaccaggcggctttgctgacgtgggctacacgccgactgaaaatgtgcaacgcgaggtgtgggaagagactggccgtcacgtcgcggttcaggggctcatcaccgtttttgatactgctctacgtgtcgatattccccaaccatttcagtattataaattggtctttgcttgtgaaattactgatggccaatttgaacctaacattgaggtcgcccaaacagcctactttacgctcgacaacttgccaccgttgtcccaaaaccggacaaccgaagaacagttggcacagctaatggcatcttccactaccatcacagtcgactaaatgactgctgaagcgccaaaaaccaggacgatatgttcttttattgtgcataaaaatagtgttgatggataaaatccatcaacaccaaataccatagacccaaaagacttaagtaaatatgtcacagtctccacatttttcgatggaacatatactttttgtaatagattttaagatttattacaactgttaaaggctttcaccaagtgtaatttgatgttgtactatctgaccaatgtgtatattagttcggatacattcatactggcacataatattgaatctaagttcaataaaaattttattaaaatagtggtttaatcacccagttataatgattagatttttgtatttatcaattagcatctcaatataatacgtaactatatgaaagttattctaggtaattcctagttcatataaagaatcccaatgccaatttatgcatcttagagcgtaaaagttgccacttagaacctttattaaatttaaccaatgaaaagtattattatttgcaataaagatatggaggtgatgtaagtgaatgaagttgtaatcacaggaattggtattgtaactccaatggggattggcaaggaaaaattttgggaaaatgatttttcaggtaagtcatttattactgagaacacagaaatggaagaaaatgatttaaagtcgaatgtgagctgcaaattggcaaactttgatgttcaggattacttatatggtcatgatctgacggaactaaaagatgaagcacgtttttcacaatttggttttattgctggtaatgaagcaattatagactctaatatattgctagataagcatcttaataagagtaaagttggtgtgatctttagttcagccatcggaggtactccagagattcaagatgtttatgagaaattgacggacaaagggaaacattctctcaggtatcaaagcataggagaaaagttttacaacgatggaatgtttaattatccagcaacgttgatttcccataaatttaacttttctaatatctgtgcttctttatctactggatgtacagctggaatggatgctatgggtgcaggaagagcaataattcaaaatggcgaggctaacattattttagcaggtgcaaatgaagcgccgttatcgttattgacatattcaacactagattcaattggagctctctcgaagtggaagggtgatccaagcgcagcctcacgaccctttgacaaaaaaagaaaggggtttgttatcagtgagggcagttgcgttctagttcttgaagagaaaagacatgctgttgatcgtggagctcatatctatgcggaaatcacttcttatgcttcccataataatgcacaacatatgacagatcttaaggacagcgagacattggaaaagacaattagtgattctttgaaagaagcaaagcttgttccaagtgatatagattatataaatgctcacggcagttcaactagacaaaatgatcaatgtgaaagtgatgcaattcgtagtatctttgggaaaagtgctactagtattccagtaaattcgacgaaatcaatgatggggcatccattatcagccgctagcttaattgcgatgacaagtgttttaggggttattaagtattctgaaattccaaagaatattaatttagaatatccggatgaagactgcaatctaaatttgccagttaagaatatcaaacagaatgtagaaaacgctatggttatggctagtggatttggtggtatacattcagtatgcacacttaaaaagtttggagcgtgttaaaagttggatgaaaaggttgtaatcacgggtatgggtactgtaaatccacttggaaatgatatcaatagtttttggaaaagttataaggctcaaaaaaatgctattagagatatttctagattttcggttgaaaacggtattattaagattgctggagagatacaacactttgatgaaggtgaatatgttccaaaacggattcaaagaaaaatagatacatttatttcatatgcactggcggcatctcagcaagcaattaatgatagtaagattactattaacgagaataacacatataaaacaggaattttcgtcgggaataattctggcggctgggatatttcagaaagaggcttccgagaattgtatagagatggtgccaatatggtaaatccttggcaagcaactgcttggtttcctgcagcacctcaaggttatatttcgattgttcacggggcaaaaggtttttctaaaagttatgttgctgatacatgtagtggcgcaatagcattaaaatttgctattcaatcaattttgaacggcaaaaatgaagtggtaatttgtggcggtactgaagccccagactctaagttggcaacaatttgttatgcacaaacaggacaatttcacaataaacgtgattttcaaaaaggcgcacaaccatttgctagtaaaaatcacggaatggtgttaggtgaaggtagcactttcttaattttggaaacgttaagccatgcattaaaacggcacgcgccacatatctatgcggaaatctgtattcccaaagtagttactgagatgccatggtctaaagaagtatacaaaaatatgattagccaaatattgaaagaaaataaattacatcccaatgatatagatgtggttttaccagaaggtaatagttctaaaaacagtgattttattgaaacagaagttcttagtgaagtatttgacaataattcttgtgacattactattccaaaagcacagtttggacacttgtatggtgcaagcacagcaacagatgtaatgtgtgccgcattatttatgaaaaataatattgtattaccaacgtttggagagtatacaaccttgccagggttgaaactaactaacaaagtcaaatcgaatcaatccgttaatcgggcactaattcttggccgatctagggaaggcgtctcaacgggattactcttgaaaaaatatatcaaaggaggtgagaaaaatgaataacgtttataaatatttaaaaaaagagcttcaaacaattggcatctcagagaatgatattagagaagattcgaaactgaaagatgattttgagttagattcaacggagctggtggatttaacattatccttgaaaaaagaatttggtttggaaattgatctttcaaaaccaaatgatttaactgttggccagttagccaaaaaaattaatgaaaaattggagagaaaaaatgagtaaacaaattgaagcgtattataagcatacttatgctagtgagaaaccggcagaacatgaatggacagccgggacagccaatccagagttagttgatttagtttataaccaaacaatcaaaccagggtctaaaattctagagattggatgcggacttggagccgagtcaactttcttggcagttcgtggtatgaatatgacctcggttgatatttctcaagatgcagttaatactgcgaagaagattgcagatgcatatcaggttaatgttaattggaaggttggggacatcctacagatggatttaccagaacaaggatttgacgttattacggatcagggttgtttccatcatttaactaatgaggaacggccagtgtatttaaaacaggttatgaaatttttaaaaccgggtggaatgtttattctacgttgcttttcagataaaatttctggaggacctcaaccgcggcgaattactagtgatgaattattagatactttttatccggaattgaaactagaacatatggaattagtgctgtcattttcaaccaaagagcgtaacttgccacaagggtggtttaccatttggtataaacgataattatttgattattggattaggtattgatgtccaagctgaaaatagaataaggaaattagaaaaaaggtacggtgaactgctcataacggaaattttcaccaataaagagtggaaccaagcacatggttccattttttcaaacccttataaaatattaacaaataaattttcatttaaagaatctgtatcaaaagctttgggaacaggtattagtggctttaaatttgcagatatagaaatcattggaaatgcgtcaaatccaagaataaagttctataacagggcatctgaaatatataaagaaaaacaagtagattatgagtctacttctagtacgtattgtgatggaatagtctttacgcaagttattttttggaggaagtgagattaaaattatgaatgataatgattttgtcaaacactgtttgctgagtcagagagcagataaaattgcaattgtttcggataagaagaagtatacctatttggaaattagagaaaatattgccaagtatgcagatcaattaaaaaacttttttttacccggggataagattggctttttatgtgatgactcgcctgaatatgtatttttgttctgggcagcaattattagtggagtggtacctgtattaattaatgttcaaaatgatcaagccaattgcaactatattgttggagattgccaatgtaaatgtgttgtagttaataaggacgagctgggttgtaaaatcaacaattgtaaagtaatgaagatatctgacttgaatcaaagtgaggtgcagtcaagtcaattagaaaataaggcttggagtttacaaaaagattatgcatttgtcctatatacttctggaagtacaggaaaacctaaaggagttccacacaaaatcaaagatatggaattttgtgctaaaaattttcagaatacagaattggcttttcaggaaagcgatgtgatatattcagtctcaaaaataccgttcgcttttggatttggtaatattatctatcttccattctattcaaaagcaactatttgtatttctgatgataatgacatatttgctattaaaaaatttattagtaaagtaaaaccgactatattgatggcagttcctactatatacaataattttttgaaagttttttcagaagcacctgctagtgttaaatcgattagattaaccatttcgtgtggggaagttttaccaactattgtagctaagagatggttgaattattctggcaatgtgctcttagaaggaatggggactactgaatttttgtacacgtttctgataaatacattaaaagagaatgaacctggaagtacaggaaagccagttccaggttatatcgttaaagtggtagacaagaacctacatgaacagagtgttggtaaaattggagacctttttgttaaagcagatagtctgatggaaggttatcttaatagaaacaatgaagatatgaatcttttgcgtgatggcggaatgttaacaggggatcaatttgttgtagataaaaagggatatttttggtacaaaggtcgatctttagataattttaaagttaatggtaaatgggttcgtgctgaggatatagaaaatgaagtcttagacaataaatatataaaagatgtagctgtaatagcggctaattcagatgagcgtgttactcagattgcctgttatatggttctagaggaaggatttaatttacaaactttaaaacaacaattacgcaaaaaattagaacactacaaattgcctaattattattatcgagtcaaagaaatcccaaaaggaattacgggaaaaattcagagaaaagctttgataaacttagataaggaggagctgcagtaattatgggaaaaaaatatttagtcgtcaaaggtaagaattcgaaagtaattgagacaccctatggtaatgtgaagactttgattgggctctctcaagtttcagatatctgttgtggattaggcatgtcaacaatgacttcaggagcctatgttaaacaggtacatgattttagtgacacccttgtatttgtcttatctggaaaaggaaaaatatcctttgataataaaaactggttagagatcgcccaaaatgatgctgtttttatcaaaaaaggtaaggaacacgaaattaaaaatgttgaaaaggttgatttgaaagttgtgtatttctctacaccgcttgctgcaattcctagtgatggtcacagatttttaaattaaggaagtttaattatgaagaatattattaaaaattatccaaatgtttcgaatgctttcttttcattaactgatgcagtaacagatgcctcagattttgataagaaaactaaggaattaattcttattgggatgtttacgatgaacggtgggattggaggactgagaactcatagtcagcgcttcatagaggccggtggaactttaaatgaagcattaggatgtattctacttgctttgccggttgttggaatcacgcgagtaaatcaaagctttaatgctatcctaaatttggcaaaggaattgtcgctatgaaagtaattgatttaagtgtggaaatagaaaatagtagttcggaaccaatgaggttgaaacattctagaaaaaaccatgcggatggtgcaaaggagatatcaaaaagagctggtatttcgctagatagttttcctgagcatgagtttctcacactagatacgtttaaactcgcaacacatatgggaacacatattgactctccttatcactttggcagtcattttttaggtgaaaaagctagaacaattgaccaattaccgttgaattggttttttggaaaggcgataaagttggatttttcgactttttcaaggaagaaaaatatttcaaaaaaggatatcattgattgtctaacaagggaagttattaatatacatccaggagacatagtgctaattcagacagggatggataaattattcggacagaaagaatattttactgatggtccaggcatgtccagagaagcaacggaatatttgattaattgtggtgtaaaagttatgggaattgacgcatacggttttgaccgttccttcccagtcatgttaaatgagtataaaagaacaggtgataaaagcgtcttatggccatcccactttttaggaagaaagaaagaatatgtgcatattgaaagattaactaatttagatttattaccttcacaggggttctatgtatgtgctatgcccttgaagttaaaagacggcgacgcgagttggaccagagcaatcgcaatgttaggggatgaatttaattgaaaattcagaactctattgagatttctaaaccattagattttgtttttgagcatacaaataacgtggaagaatggccattgttatttacagaatataaaaaagttaggattattgaaaagcataaagattatgtcaaatttgaattgtgctggaccaataatgagaaagaaaacaagtgggtttcagagcgtataacggatagagaaattcatcatgtctatggaatcagaatctttcccatgtttccattcgactttatgaacattgtttggaaatatcaagaaagaaaaggtaatacagttatgacctggtgtcaagaatttgaaccagatattagtgtgaagcaaagggatcaaatgcaggaattcttagataagcaatctcaagagcaaatgaaaattattaaagataggattgaaaaaatgaattgtgaagattttaaacaaaaaaactaaaactattgaaggctttcccataaattggtatacaaacgtagatttttgcttcaatggtagtgtatttctatttgttcatggagctggtgaagagccaagttgttgggatcagataatacaagcgttgccaaaaagggaagccgtaattgtttttgaacgtccaggatatggtgactctgaaattggtccattatcatcgattaaagaaaatgtggttttattggatcaagtaatcgatcagtataaaagtgcaaaaattatcgtggtaggacattcgcttggtggatatatggcattaaatttatcttcttgcaatatttatgggagagtactaattggatcttttgcacattttagaacgaacaggatagatatatcttcagaaaaacttttgcaaaatattagaaatggtttttctatatctactccatcagtaataatagatagctttataaaaaataacgtagcaagtgaaaaatgttttgaaaatgattataaaatgacacattcacttgaatatccaccaaatattcaaaagttaccatgtgatacgttagttattcatggagtagatgataatgtagtttctgagcgacaaacaaaaaggcttgtaaagtatattatctatgcaaaggttgtaaatataccaaaatcagggcataacgtcattgttgaaaagccgagtaagatttcagaactcatttgtaaatatgtaaaagaggtggggcaatgaaaaagtttggtgtaattttttgtggtcaaggagtacaaaaagttgggcttggatcctcgctgtattcaaatactattaccagtgatttcttactaagtttggacaaaagtgcaaattttaatcttaagaaattattgacacaatccgaaaaaatactggtaacagaatatgcgcagccagcattgttggcttactcattgtcactttttaacttcgcagcttctaagttgaaaaaaataggtgatattgaatcatttgcaggactatcattaggcgagtatacagcactaggagcttcgggtgtcttattaaatgaccaactaatgagtattgtacatcatagggggaaattaatgcaggagagctgtattaatcagcgcacaacattaatcgcagtgagtggaacaaacgtttacgaaatattaagtaaaaagttagaatacgaaggaaatcgtagcttctatattgctaatataaatagtccaacgcagattgttatcggtacgatttacaaagatgaaagggaactaattaagagtctaatggaagattgcgcctcactggtttgtacgcctttaaaagttgatggcgcgtttcataccccctttatggatgatgcaaaccagttgtataggaaagatatattaacactaacgcccaattttaacaataataaggtttattccaattatagtggcacactgtataatcctaagaacttctttcgcaatttgtctttgcagatgaatcatagtactcatatgagcaagattatcaaatcaatgggaaacgacggaataaattgtttaataacattttgtcccaatcgatcattgatgaagatagttaagcaaaatctaccatcaatgaatgtaatcaatattagcagtcccgcagatattgtaagaaagataggttaaataaagatgaaaaaacaaaaaattttaagtatggtagataagttttttacagagggcttagaatatttgcaaattagagacgctgattttagcttatcattggaaagcacaaaacctgaggctgaagaacttgaagatgtgaaagaaaataaaaaagtatccagtaactatgtgtatgttaaatctccggcggctggtttatgtgtatccgaagaaggttggcctaaaaagggagataaggtagaaaaagaacaggtactatttaaagttgaagttatgaaaactttaattgatgtcaagtgcagtgtccctggtatgatttcaaaagtttttgttcagcaaaatgatgaggttgtaatcaatgaaaagctagttcaaattgaaaagctaggtgagtaatttgataaaaaaagttttaatcgctaaccgtggagaaatagcaattcgcacagctgaatttttatctgataatgagattgatgtagtagctgtttatgcagctgatgattttaatcctgttcttaacagtttaagtgctcaatacttgccattggggcagggtgcactagaaaaaacatatctaaatagatataaactattgaaaattgcacaagagactaagtgtgacgctgtatatccaggttatggtctcttatcagaagacggagattttgccaaattggtagaggcaataggattaatttatattggcccatcgcctcaaaatctttacgatgttggaaataaatatcaaacaattcagttagctagaggtgtcggactgccaacagcttgtatctttaataaaacatttgacaatgtaatggaattagacaaaaagctaaatggaaaggattatcctgtaatcctaaaatccttaaatggtggtggcggtaaaggaattagaatagtacaaagtaagcaagatttgatgagtgcttggaataatgctgttaaggaaagcagattatcatttggtaacagcaatatggagttttatgttgaacgatttttgacaaatgttaaacatattgaaattcaaatagctagagaccaatatggacatgtaatttgttttcctgagagagattgttctctacaatttaaccagcaaaagatgatcgaagagtctccttgtaggcttattaattcgtttatcaggacgcgacttcaagaatatgctaagaggattgttgatgctttaaattatgtaaatgttggaacagttgagtttttagttgattcattaggaaatgcattttttttggaaattaatggtcggatacaagtagaatatccagttagtgaaattgtaactggaatgaacttattaagcatacagttcctgattgctgatggaaggtctataaaagctaaatttttaaaacccaagagtagcgcaattgaatgtagattagaatcaataaatccaaacacctttattccatctgtgggtattataaaagatatgtatttgccaggtaatggagaagttgtgagaattgatgatagtttatttctcaacaaaaaaacatctattttttatgattctctgcaagcaaagataatttgttcaagtatttctagagataagtgcttgtctgtgctacgaagagttttaaatgaaatatacattgttggattagagactaacttgtctgtgttaaaacagtttttatgtaatcgaaaattgaatgaaggaaattacacaatatccactttggacaaatgggttagggagaaaaaacatgcaaactgatgtagaaaaattaatttttgattgtcctagatgtaaacaaacgttagatatattcagagttggtgatttaaaaacttgccccttttgtaactatgcttttcgactgagttatatagagagactctctgtattaaaagctgattttaaagagtggaaaataaaaaaaagcatatttcatccagtttctaagcgatataaagaaaaaatcaccgaagtacgaacccagacaggacttaatgactcactcattataggtgaggctattattgatcataataataagattgctttgggtatttttgattgtacttttatgatgggaagttttgggactcttgttggagaaaaaatgagactactttttgaaaaagccaccgcgaaaagtttaccggttgtacttttctgtgcttctggtggtgcacgaatgcaagaaagtccagtgtcgttattgcagatgcaaaagatgaattattttgctggtatctttagaaaaaacggtggttttttaattagtgtattgtgtgatccatgtatgggtggcgcgttagcttcaattgcaaattgtgccgatgttgttcttgccgaaactggtgcacaaattggttttgcagggttaaaagtaatacagaatacaattggaaagaaagtcagtattcaatcgcaattagcggaaactgtttataataacggatttattgatagtattgttcaacgtaaatcattacccaatttgctgaacttgctgttaaacctgcatggaggaaaattaagttgaacacttttttaagtagagtacgtgatataaataggttctcggcagaacaagctgctgagcagttatttgattcatttgtgaaactgagtggtgatagagcaactggtgttgacagtgcattggtgagtggaataggccttttaggacataagccagtaacttttctgggaattgaacgtactaacatcaatggtggttctttaacgccgtgtggttatcgaacatgtttacgacttattgaacaggctgaaaagtggaataggccagttctaacttttgtaaacacaccaggagcgtattgtgatctagaagcggaacgttttggacaagcccaaattatttctgaattaatcagtaaaatgactagtatttcagtaccagtaatttctttactgatgggagaaggaggaagtggcggagcactagcattaatggtagcaaattatataatagcaacaaataattcaatgtttgctactatttctccagagggctattcgacgattcttaatgggaaaaagacgtcaaattttatttctcagtcaattgaagaactacattgtaagtctaacgaattaaaaaagtttaaaattgttgatgaaattattcctgatattggttcaaaagagccaaaaaaagtgcaagatttaaaagaaaaattgattcacttatttaaaggaatgtgtaataagaaaacttctgaaatagtagctgaacgagagaaaaaaattgaaaaggcaatgattttatactttaaagagacaactaatgtttgaagacaaggctaatgacgttaaaactaaaaagaccttgctttgctttttggccaagttttattcgtattggttaatgatgcttattagtgcattattaataagtactgtgttaaaacaagtacaagttggtattttgctattagtttatataagtcttttaagatcattcttacctggttaccatttcaaaaagattcatatatgtttcatattttcactatccttttttagtttattaatcatgagtaatggtatcatattgagtcttttcgaaagaattgaatgttttgcaatatttcagttttcattgtctttaataggaagttatctgcatgagaaattgatacataatcttatgctttttaatctattatttggtgtatttataatggattctatatttttcaatgtattgattacaggtcagataggtgttgtttctctatttgtgtataaagtggaggttgataatagtgtttactagattaaagaagatggctttgaaaagacttattaaatttgcgatgagatcaaactgtgtttggtttgcttatgagttttcaattccaaatgagcttaataatttagatattttaaaagaaaagaaggggattaaaaattgacagttgttggtgttatagttgcaatggatcaagaaattgagtccttaaaaagaagaatacggcacatgaaaaacaagatgtttggaaatgtcgaatgttttattggtgatatagataatgttcacgttgtattactgaaatctggaattggtaaggtacaggcggcaattgctgctacaacattatgtttgaattttgatatagatattttgattaattctggatccgcaggcgggttacaggctgatgaaagcattggtgatgttattatagcagacagggtatcctattatgatgtggatgcaacaatgtgtggttatgaacttggacaattacctcaaaagccactatacttttttccggatactaaattagcagaaagtgttcataatttagccacagatctaaatataaactttgcaagtggactggttgtttctggtgatagttttataggtagcacggttcaaaaacttgctattaaacataattttccaaatgctttagcatgtgaaatggaaggtgcctcaatagctcaagttgcatataattttaaaattccatttgttgttattcgttcattaagtgacaatggaaatgaggatgcaaatgaagactttgataattttgttaggattgcagggaaaaaatctgcttcactggtaattgatttaattaagaaatacaagaattagaactgtctatgtagcttttcaattgttaaaataatcggcaaaaagaattggctcgtatctgcgagctgatttttatttctatgtaaaactcagtaatttgagatagcttttaatttacaacaaaactaaaagattatacttattgcccacattgctagccatgcaattagcataatagcaccgaacatgccccaatttaggaatatgctgaatacaaatagccagaatgccaacttacgtaatcctttaaggtcatcgtatgagaaggctgactgaccactagctttacgagcattcgacctatcagcgtgttgttcgtgatgataccatcttgatagtcctaataattgtaataaacttccgaacatttttcattatctcttctctttatcggcctcattagggaccattgcactggcaacattatctagccagtcctcattagaaggctccttgttagtatcgtaaattccttggatgaagtcttcaaactttttatcggccaacctttgttgttcttctttctttttatcttcttcattcatgcgttagcctcccatttatctctccactattaatagtataacgattccatctaaattgtgattattgctagttattttgagcgtctgctagtatatatcttcttcaccgttcgatattcagcacgttcctcatttgttaaaccttctagtgtgctattaattgtgtgttcaagcatctcatccacacttttaaaattaagcactgcggataatgcatttaccatatcggctgtctcaactgagcatctaattgtagtagttttaggcttagactttttagtgtttgctttcactttcatgtcccgcgaaaatatattgctaggtttcggaacttgagtaacatctgagttaaggcttttcttgagcaggtctttactcatctttaccaaccctttcaacaaattcatttgtaattttcttatatagcgcatctactcgcatatcatgcatatcatgtttttgtgtttttaaatctggatcaacaatgccaataatgtcataacgttttagccgttccatatttttaacaacatttttaaaaatattatccttgtcaaactcagcctcggcttgttctagtatcgactgatcaacctggctgttgttctttagcagaaccggtagtattcctgcaatgttgaaatctgcgtcataattagagacaagctcttgcaggtaagatataaaggcctcagcacctacatacgaccgttcttgagtttgaagcacaattataacgctgtctgaggccattaacgctgagtcagtgtatacactaacagtcggtggcgtatcaatgataatgtaatcgtagtcatctttaattttatctagcaaatttgaaaagtgtttagctcgcttatattggtcatctgtgttcggatacttcttttctaagaaaattggatatgatgtaaagtctgcaaaactgggcaacaaataaagattgtcacgaatcttagtaacaatagtacttatatcatcattgctgattgcattcattaaagtattatcaaatttaacaacctcattattttgaacttgtttagtctttagatataatgcggttgcattagcctgcgggtctaaatctgctagtagtaccttgtatccttgtttagctagtctgtatgaaatcatgcagctgttagttgtttttccagttccacctttgaaatttccaaacgtaataacttttaccattctgctagcccccttaatctcactattataattcatatagcacatattatcaaacgtctacatgtagataaatatacaaatatacaaaaatatatgtagactaaaatacaagagtacatgtagatatgtagatagtttagctaccataaaagcttgtttaaacagcaataaatacattctatttcctattatctatatgtatacgagtatacataaatgcatgtagataaatagatatgtagatttgtagactaaattaaaaaatgttgacactcgcctaataagaagctacaatatccttgtattaaaaaaggcctagcaattaagccagacctaaaataactgaatatacaaaagaagtcccgcgaccttctacttcgcgggaaccacaaataaccatgtgttaattgtacggtctagactctaaaattgcaagtcttgacattcaattgcttctcgcggaccattctaggggacaagctagagtataaatattaaggggacacgtttaccggtgcgacttcaataacaaccggttatatcacataaggccttagacaatcaggctggtgatgaatggtgagggcgaccattaacggcccgggtggtaaaacgatgcttaggcatggtgaccactagtagctggtaaccgaacaaaactaaatacgtgctatcagcgtccattagggcgttttttaatgggtttaaccgagaatgtaggttgatactagtggttggtagcaataccgcaactgattgtccaagcgatgcccgaacgaccgagcgttacaacaggtgagttgcactctagctagatagtcattttaattttgatcgtctgactagggtacaactctgcactcaaccacttcactccctcgcattacagcaggggtaaactaataagtcaactaaattgaataaataaataataatcacaagccagctaactaggacagtttaagttaatttcacaaagtctaaatgtgattaaaataggctttggataatctagcttaaaccagcctaatttcacaaactcagctaaactggctaaatcaaacagcgagttgtctataaacactgatacaataggcctaactagacttcacaaagtttagctttgaatactttgacattatgtgaagtagaaattggtatactaaaaaatcctcccagtttaatgctggaggattttttgtgctatcgttattgaaaaattaaagtatttttatgatgcatattgcaaattagtacgtttttgcttttttatggtaagcaaatctttctctccaacttaaccgttttctttcttatctggtaaagctaaccattttgaagtgtcagaccgcttttagcatcaaacagataaatattagaattacgaatataaagatctaattttttgtggctatcatcattaggaattcttttaggcgtttgagtcacaatattaacaccatctttagtttttagatagacaagcgtatggccgcccatgtattcagccagatttttacttgcagaaagtacaaaaaatcccgctttttgtgcagaattttcaggagctgtatcattatctcctgacttttttacctgcgttactttctcaggccgaaagccaagtacaatctctcttttatccgttggcaaaacttcttttttcacgaattcactaaggtcataatttacactacctgaattaaaaattcccttgttcgaaagagtaccctttaaaatattcatgctgggagaaccgataaaacgagcaacgaagaggttacgcgggttatcataaagttcttcaggtttaccatactgctgtaccactccgtctcgcatgatcaagattttatccgccattgccatcgcctcagcttgatcatgcgttacataaatcgttacagttccaagctgcttatgtagctcgataatatcctgcctcgttgaaacacgtaacttcgcatctaaattagaaagcggctcgtccattaaaaagacttcaggtgcgcgcaccattgcacgccctaaagcaactctttgtcgctgcccaccagaaagctgcgcgggtttacgagccaaatagtctgtgagattaagcttttgtgctgcttccttgacccgtgaatcaatttcacttttagaaaatttactaagttttaagttgaacgccatgttattgtaaacagtcatatgtggatataatgcataatcttgaaaaaccatcgcaatgctgcgcttttgcggtggaatattatcgaagcgctttccatctacattaatttttccctttgtaacttcttccaaacctgaaaagcaacgcaatagtgtagacttaccacaacctgatggtccaataattgcaacaaattccttgtcatcaatctcaagattgatatcctttagggtatcattttccgcattatcataacgcttataaaggtgttcgatttgaatcttactcataagaaacgcctcctcgagtttattctttgcttttgtttctgcagtgattcataataaaaacataaaatttaggtaagaaagaatggtgctcttgacaaacaattgacaatgaatcggggcggaagacatgaaaaaaagattttttaaaatcgctaagctaacttttatgttgagtttatcattaattgtcttaacatgttgtagttttagctcgcaaaagggaaaaaattcaaaaattacacttaacttttttaatcaaaagcctgaaataaccgcacaatatcaaaaattagcgcggatgtatcatgctaaacatcccaacgtcaatatccaaattactacttcaggtcaaggcggtggggccgctgctttacaagcgaagtttgcctctggggaagctccagatattattatgcttggcgggctacctgaaatagatcggtataaggatcatttgattaatctaaaagatcttaaggcaagtaaaaacatagtaccaaatcttgttagcggtggaatttcaaataaacgtatggttggaattccagtcgatcttgaggcttatggctggtcgtataacaaagctgtgttcgctaaggctgggattgatgcctcaaagatcaataactattctgaatttttgaaagcggttgaaaaactcaattcagaaaaaaagaagattggaatcgatgccgttttcggctttaacggagctgataccaattcaattgcttctgtttcagcacaatttacttctctgccgtacaacaataatcttgtcaaagctttcaaaagcaaaactttcccttggaaatacgagaggcaaatgaaaaattattttgatctcgtaaaaaaatataatgtacaaccgattctttcagttaaatatgatccttctgtccaagacctttttttcaatggtaaagttgctatgatacctcaaggaaattggattattccgacgcttgatggtctggaaaagggatacgtgcaaaaaaatcttggcatgttaccgttctttgttaaaaatgatggtactgaccgtcttttgaccggttcctcatggtatttaggaatcactaaagatcatcccaagcggcaaaaagctgctaaagattttattaactggatgtatacttcaaaagaagctgagaacgtaatcattaacgaaatgcgtttcgttcctgcaactaaaaactttgatgtttcgaggctgcctgatgatctttctaaacaaatttatcggatcggcacttccaaaaacgcacaatctcctgttcacaaacagtacccgaatggctttactaaccaagcacttgggccatatatacagcgctattttgtaaatgggatctcttggaaagaattgaaaaaggaaacatcggctaaatatcgacagctcagggaaatccaaagtggggagtgataaaaatgcttatcaaaaaacatcaatatctggcttttgttttaccggcagttttctttatactattgattattgtcgtaccatttctgataggaatttattattcctttaccgattccaatggtttacgctcttcttttattggttggaaaaactttgaagtcctttttcaagactccacctttctgcagagtttttggctaacagttagattttcttttgtttcagtaattctaattaacttagtcggtttggcttttgcgttaatcgtcaccagtcacaacaacagactcacaaaatcactcagaaccatcttcttcatgccaaatctgatcggcggaatactacttggttttatctggcaattcatttttacttctgcttttcaggcaattgccgctgcttttcatcttgactttttcaaaggttggttgagcaacccttcaacaggcttttgggggatagtaattctgtttgtttggcagatgagcggttatattatgttaatctatatttctttcttgaatgcaattcctaagaataccattcaagcagctgttctagacggtgcaaaagcaacccagattttctttttcattaagctgccacaattggcgccagcctttacaatcagtctatttctaacacttgccaactcgtttaaactctatgagcaaaacttagcacttacaaatggtggcccataccgctccacagagatgatttcgatgtatatttataatactgcttttgtaaacttccagcagggatacgctcaggcagccggaattatccttttcctttgtgtaaccattgtttcctttattcaattagcactttcaagaaagcgggagggatagaagatgaaaaaatcaactaaaatcttacttggctttctttttggaatcattgccctattctggttctacccctttatcattgttattatcaatgctttaaagggaaaaaggggaatttttcaaaacccgttatggtttacacgggactttacgttttcaaatttcaaaactgcttaccaggcgcttgattttacaagcagtttctttaactctttagttatcacagtagccagtgtcattgtaatcacattggtttcggcagctgctgcctatgctctttctcgtgttaaagggcctttcagttcaattctctactatctttgtgccggcactatgctgatcccttttcagtcaattatgatcccgcttctttcactttttggcaaagttaatttccttaacagaacgagtctggtcattatgaacaccgggttatcagtaagcctctcaattattcttttttatggggcttttcaaggagtctcaaaaactcttgacgaagctgctgctttagatggagcctatccttttaaaacctttgtttatattatctttccagcggtcagcccaatgacaggtacagttgttatcttgaatgcaatgaaaatatggaatgactacctgttaccatcactagtcgttaataaagatggcatgtacacgattccacttaagatgtattctttcttcggtgaaacaaacagccaatggcaattagccttagccggacttgttttgtcaatggttccgattattattctgttcctcctattgcaaaagcaagtcatgacaagtgtgacagaaggagctatcaagtaaagattggatttaatctaaataaaaatagtacaagagaccaggtcaatctgacctggtctcttgtactatttttgtaatgttcatattattcagcagttggatcctctggacttaattactcataaagtagattgtaaaattaatccgaacgctgttcggacaaaaaagatcagcttcctttaaaatggtgtttaccacaaacccatcttttaggagctgatcttttgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctgaattagcacaaacagatgccgaatacaagcgatcacgatgtggtcggaaaactaagctgagcgatgagttaaagcaaaaaattctcaaccatttacgtctaagctggtcaccaggaatgattgctcacgaatttaaactagcgactaaatctatttataattggctaaatcaggggagaattggtttctccttgaatgatctacctgaacatggcgtacgccaacggcgtaacgttgaccaacgatccaaatataatcaatctttggggcgatcaattgaacagcgtcccatgatgattaatcaacgtaatcgcatcggcgattttgaactagatacagtcgttggtcctcgtgggcatagtaaggcagttttattaactttaatcgatcgcaaatcacggttcctttgggcataccggttaaaagatcggacgacagcgactgttaatgaagcactaactaagttcctaaccacttttaatggtccggtgcacagctttactgtggaccgtggcactgagtttagtgggctagtatcacttgaatcacaatatggtattaagacctattactgccatgcttatacgccagctgaacgtggtagtaatgaacgctttaatcggaatttacgttatttttatcctaaagggactcgttttgagcacattagtgctcaagatttaacgacgacgttactccactcaagatttaacgacgacgttactccaaattaaccagcgaccgcttaaaatactcgactggcaaacaccgtatcaggttatgctgacaaatttgtccaaaaattcggattaaatttgcaatctaccttatcgttaaaattaatgttgatgttatcattcaagtttgtagcatatcttgaaaaaccagcgatatttaaaacatcaacttgtaaaagttctgtatccgtattttggttattaaagtctgcattcattttttctaatgttttaaccatatcatctttattattatagtaatcttcaaacttagatttcaaatcgcatttcaaatcaaatccatttcctataaccaataatcgtgatactacattctgagccacacaaagacttctttctataatttaaaatagaggaattgttctcttcacttataatataaagaactaattagcgctaaaaatcttaattgttcaaaatatattttgacgattttcccttgccaataagttttatccgctgacttttcttcaattcactgagagctcgcttaattgttatatcgctgtattgcgggatcagggccgtgagctcacttctagacaagggttttaattcttgcgttaatgttgtaagaattaaatccgttgccgacaatggtttatcttgtaccagattgagccgatcattaagattgcgatatgctggcaaggtatgattttcaaaccggccattgcgatctcgaggaatggttaagttaagttggccgtacttcgtatcaaacgagcgctcataactgccgttgcggttattaccagtgttaatcccagcgtatgagtagcgttcgtaacccaaaaactctgccaattcggtttgaagcagctggttaatcgcaatttcgaggtggtgacgaaaaacttcgtccaaatcttgcttttgggctagtgcagcgataatttctgtggtaagttcattcatggggaatgcctcctgtgatgttttctgtgattactaaatatcataagggaaggcattccctatttctatacaattcagaaatcttttatgcatttacacaagatattttacgctctcaaattaagtggggctaacactaatcggccagaactgcaaaaaatgctggcctatattcgtgagggtgatattgtcctggtcactgaattagatcgcttaggcagaaacaaccatgatttgactaagatcgtgaactccattcaaaataagggtgccaccctagatgtgttaaatttgccgtccatgacagggattgctgacccaaatttacgtcaactgatgaccaacttgattattgaactctataagtatcaggccgaaagtgaacgtaagcgaatcattgagcgccagcagcaagggattgccttagctaagcagcagggtaaatatcatgggcgcaaaccccaatacacccaagacgatccccgcttgcaacatgcttttaagctttatcagacgggcatgagtgatgtagacgtcgcccgtaataccggtattaagcgaacaacttttatcagatatcgcaagaagtgcaatataaaaagatgagatttacatgcgataattacgttatactagtttagagagggcgacataatgatcattcaaacaaatggacttactaaaacttatcaatcaaaagtggtggttgaccatattgatttagcaatcaaagaaggaagcttaactgctctactaggacccaatggcgctggtaaaacaaccactatatcgatgctcacaaagatcttaaatcaaaccagtggaatgatcaagatgaaaccagacataaagattagcatggtatttcaacagagtattttagataatgatttgacagttatggaaaatttgagtattcgaaataaactttataaagaagccaaatctaatcatattgatgctttgattcagaaaatcgggttaactgaatttattaatcaaaaatacggccgactttctggtgggcaacggcgacgagttgatatagcaagagctctacttaatcaacctgatattatttttttggatgagccaactacgggtttggatatccaaacccgctcggcaatttggaaattgttgcattcattgcaaagtcaaaataatttaaccattattttgacgacacactatcttgaagaagcagacaatgcagatgaggtttatattattgatcatggcaaaataattgccagcggatccgctgatgaaattaaaacacaaaactctagcagtaaactcgtgattgtttctgaacaagctgatcaattaatggcattgataccaagtaaaataattcatacgcagattaatcataaaaccatttgtttaaaggctaattctgacgaagcactctcattattattaaagtttcgtagtttcattaaaacgttcacttatcaagaggggacgatggatgatgcttttttgtcattaaccggaaggaagatgcgttgatatgattactttaacaaggagaaatctactgttgtatttccgcaatcgccccggagtattcttttcattattaggagcaatgatttcatttctcttatatattgtctttctaaaaaagtcaatgataagtagctggaaaactgtccctagttctcaccaattacttgatttttggttgattggagggactttatcagtgactgccatcacaaccacccttacctcacttggacaattagtaaaagataaagaacgcaaggttattaaagatttttatttaacaaacctttctcattttgaaatcaccatgagctatatgttaagtgccgctttgattggctttattatgcaaataattatgttcgcactgatgataggatacttttcaatcacagataacttgaccatgccatgggagtcgctaccagctgtaatttgcgttgctctttttagctctttactagcagttgtaattaatatgctgtttatccagtttattagtcgctttgattccttgaacgctataggaacaattgttggcacggcctctggctttttagtgggtacctatattccaattggtattcttcctaactttgcgcagttacttatcaaattaactccgggtgcatatgtagcagccatttatcgacaaatacttatgacagataaattaaaaaccgcttttcatggtcagcaaagccattttgaaaaaacgatggggattaagttagagtggcatcatttattaactggaatgcaaacgactgtgctccttaccatagtttttttattaggaatagcagttttactaattgttgacttaattcgaagcaaggaaaatgtgagaacggttgattgagatagcaaatatgatgaaacaagtagaccaatgttttgtgattattgattaagcattccaagtgaattgcgagggatcaataatgcctatagaaatccgattaaattggaatctaccaaatgagcatactcaatttgctgagggtaatttgttgtccactagctatttcttagttatagttaaggtagaaacagactttatcaaaaaggagtgggaaagttgaaaaagttagtacggtatgtgtgtgcagtagttgccatgttattcttggtggcaggctgttctagtaattctactcaaaaagaagggtcatctacgcacagtcattcttctgagaaaacagaaatgcacgagcatacaggttcgaaaaaagtgcatggtttaaagaaagctgagcaaccaaaatataaggccggtactaaagttaagttaacggcagatcatatgaaaggtatgaaagatgccaatgcaacgatcgtaaatgcttatgactcgaagttatacgcagtagattacaaatcaacttccgataaaaaaatggtcaaagatcataaatgggtcactattaatgaaatggagggtaatcgaaaagaatacaaaaaaggtgataaggtaacattaaaagctgatcatatggcggggatgaaaaatagctctgctacgatagttgagatccaaaagggaccagcttacatggtaaattatcagcctacaaatggtggcaagcaagttaccaaccataaatgggtcgctgaagatgaaattgaaaaacgttaatataaatctgtaacaaaagctgatttaaaaacttttagtgatcagcgttgaaatagggatcaaagcaaaacttttgttttggtccttttttgcgcgacgaattgtcaaatcaagtgtaactttttaccgaagaaaacttcagacggtgtcttccagactaagaccttacggggtcgattatttaaatccctgacaaacttcgcgatatcttgatcggtcagttcatcaaggtcagttcctttgggaaaacactctcggatgagaccattggtattttcgttggtcccacgttgttgtggtgcgtgcgggtctggaaaatagactgagataccaagctctttaccgacttcacgataacccgcaaactctgtacctcggtctggtgtaagcgtacgaacgcgtttaggtgtgactgtatgcaggaggtcgatcatcgcttgggtcacattcttggcattcactttgggtacacgctcagacagaaggtatcgtgacttacggtcgaccagtgacactaaacccgaacgcccgattttgccgcgaacggtatcgccttcccaatggccaaaacgagtccgattctcacatgagactggtcgttcatggactgatgggacattattaaaacggccacgtcgttcgttgacagttcctttaaccttacgagttttcccacgatgtcgtaactttcgagcgaatcctcgagtcccatgacttttacgtttaacgcctaaattatttcgttcaattccgcgataaatcgtgttgtagctgatatgccaattactgttctctaaagataaacgaccggcgatttgctcgggtgaccattgccgttgaagaatgcagtgaaggacaaagtcgcgtagctttaaattctccagtaccctgaggcgacgactctttaatcggcgctgttgatagttctgctgggcttttacggcagaataggcaccccgaccgccgttgcgtttaatttctcgtgacacagtggctttggaacaaccgatttgatcggcaataacctggtaagtatggtgtaaagttacacctaacagtatgcattcgcggtcttttaaggtaagatgtgtatatggactcatagcctaagaactcctttagatgattgttatggtgacttcattctacaggactcaggctaggagtctatttttattttcttacttgttgcacttcaattgtaaattcgtctatcaaaaagggcctagtacttttggaatggaaatactttccaacaccaaaaattctagaccctgtcggagtctaaaacatgataagatttagtcaattaggagaataaaaatcgtgaaaatcaaatttcttactaaaaaattttttagaccgagaccatctgaatttatctctgttcaaactgataactttttgagaaaattaaagccgagaccggcgccccgcgttggattatcggcttgtaacatcttaaatactgatgggaacattgcttgtggtttgttaaaatccgcaaagtattcttgtcccatggttgcgttagtcccttgatattccttaggtagcgtgtcccacggccgaccatgtaacatggaaatgtagttttgtgccgaaattgctggtgaaacggcccgcgctgacgtactcattgcaaactgcttattgaacaagtccatcgtatacgtatttcgacgcttcttcatgatttccggattagttgtccagacgggagtcttagttccttgctccgcaccttgtgcatagtacattcccttcggatcccaggggttcccaccaccatcagtcgttaaaacgaccacgtgtttataaggcttgatttcggctgctttggcggccgccactttatcggcagcggttgccagggcaacgtcaccgacaccaataatcccgtcaccgttgtaatctagcgcgtacttaccttgaatttcgacagcttgggctgggcctagttcgatcgtggtatccttagttggctgttcgaacttgatctgcgtctcaccagctgctttggctttcaagttaaggtgcgctagccgcgtttgcgcatacgttttaaattcagccttcgaaaggttcgccgtcgtagtcaggcgaatacggccaggcgcaatcagttggacctgcgtctttcccccttgtaaaagccgttcggcaccgacatagtcaaacttagccgcatcatacacaacatccatggtgaccggggcggcaccggtagctttgatttgccgggcgtgtacattaaggccataggtgtgtccactcgcgattcgcttcggaccaacgagcttcgtcgcaatcgtttggtcgaccggtacgggtgcgaccggctgcttatcgacctgcgcggcaacgttcaattgactcacttgttggggagtcagcgtcttgtcatacagacgggcctgtctaatttgaccggtcatcattgactgaacgtgacttccaggaaccgcgtcgccacccagtacaaagtctttagtaccctgcgccagctttaaatcgccgggcatggccacttgttggactaactggccatccagatataaactggccgtcttattcttgtcgatcacaccaaccgcatggacccactgccccttatgtaaggtgcctttaggagtcttatagccggaaccatcatgggcgaagaaaacgacttgattattttgtaccccaagtcctaagccaccaccctgttggctagaaaagatctcatgttcaccattggcatcggcggctggatcatatttaaagtacgcctcgatcgccatcccattctgcaacttcgcaaactgttgatccgagaaggtcgtgtaaaacgctgatttgccatccaagttcaacacttggtcgttaaattcagggtccttcgtcacggaaggctgcccataggtttgccactgcgtctgcccaattaaatcaaccaattgttgattttgaactgccaaactcaaggttgctgctggaactgctgagctagcaactggttcggcaacttgctcactcggagtcgtcatcggggttactgcggccacagccggggtcaccgtcgttgttaagattgctgaacaaactaataaggtcgttaaaacacgcggctttatcattataaaattatcactccatctttttttatcgtaaaacaaactgcacttttaagaatagttaaggaatgtaaaatgtttagtcagatgtttgtaaagaaacgatattatttatgttgcgacactttactaaccggctctacgctagcgatggcactcaaaaaggctccccatatcttgctgggaagcctgatgagctaatctattcctgtcgcactaagccgtttgttgataaccgtttgcaaccaactgatttctaaaccacgtctcaaacataaagccataccagatatcacccagcaagccaatagtcatgacaacttggtcattaaaaaacaactgtgtcaccatatttaacgccagcatccctaagaacgggaccgccgttttcagtaagaaaaacggggtacggcaccgcacactgaacaacgcataaaaccacgtgaacaacagggcccacacgttaaagtgtccgtatacttgcttggtactggtctcgccattgatggtcttagtaaacgtcatattatgtctagcccgcttgttaaagccaaaccactctgatggtgcaaagttcatgaaaaccctcctcgtatcctgtaaatcattataagagttaactcactaacttaccactaactatcacgcttgcgtgccaaaaaatcgttgcacttcatttgcgtaatcatacttagcgttcaatttggccaacaaggcttggtcatgggtactcgtaaaaccagtccggcgtagatgttcatataagtctaagtacggtaactgttgttcgcgtgcgctggtcaactcaagctcaatatcatagtcgacttttcgaaaatccacactgattcggcccgcatcatccaccgttaagattgcatagtgagcacgctgatcagccatgaatttagcgtatggactgtaaggttggccggtcgcccccgggttaataatgagctggccccgctgactgacccgcatgatttgttggtgggtatggccgtatattgctacgtccgcgtcaccagctaggtgatcaaaattagactggcgttcagccggatacaggtcgtgaccagtcgaacgttccggctgattatgggccagctgaaaggttaacccgttcacggccatcgttgtcgcaatcggccgttgcactaattcagcgtaatgtgctttactcagatgggtcacgaggtaagccgtcaatcgtgcaaaataaatctgggaaggatcatccaggcgaccggttccagtcatgaccgcattgatcccctgttcccaattaccttgcaaccacactgccggcgtgaggtctgctaatgtttggtatagcttctcggcacctgggccgggtaagaataggtcaccgaggaaccaataatccgtcacggcttgctgacgcgcatccgccaacacagcattaagcgccgtcaagtttccatgaatatctgccagcacggcaatccggtgtttcatttctcgccacttccttttgcacatattacttctagtatacgctgacaatttacgcttgtcgcattatctctgtaaagccagtttattaatcagcctcagcaagcgcagatggtcgtcatccgtaacatttgcatgtatgctaatagtaacatttagtctaattaataccttggaggaggcatccgatatgcaacaattaacaccattagccgcctattcagacttggcattcgattggtcgatcgtcattaacgaaggggccgcgggactagccggtattcaccaacgtctagcagcgacactcagcgactgcctggccgcacacgtgaccattctttgtcggtccgcgatgtttttcctgatcattcatgaccaccggcaaaaggttgcaatccctggccatatttatcctggtacggcacaaccttatgaaatccaactagacggctggccggtaaataatagcaccgcgtttatggcaattattcataagtatcactaagcgcttgatactacttatctgtcgttaccgaccaatcatcgaaagtgataatatattcagtgttaaccatgtgagcgctttcctccctatgttagaatatactaagaaccaatcaggggggaaatcaaattgcagattgataaacaacaagttggtagtcgtattcatcaacttcgaattaccgctggtttaagtatggccaaacttgcatctgcgattggcttggctggaaaaagcacaattaatgactgggaaaagggtcgtacgctagctaacgcggaccggctcgctaaagtagccgcgttctttgacgtatccactaattaccttttatacggtagtttgacggaatacgtcaccgcagtctttcgaaacggaggccttaatgactcggagttcaatgtcctactgtgggaatacgtggatctcaccacgaccaaccccaacattctctccagtgacttgttcagttcaggggcacatattgaacaagacacgtctgacccaactaaaatcgcagcagccttgattacgccaaccatcaataacgcgatccaacagattgttccagaaatcgttcgacgctatcgtgggcgggcgacgacctacccagaacctcaaggcgtcattcaagctggctgcaatgtctttcgccaccgaattcagatcattcggcggacctttacgggtaagtacaaccggattgtccgcttactagacaatgtcgatttatatgaaaagttacagccagacgatgatttaaagtcttacttgaatcaaacaacggggcctgcagctcaagttcaaaacggttattcattggatgaaaagtatcagcgccaaatgaacaaagtgatcacggaatttcaccaagcactcaatcgcatcaacgatgcctaccaagctgaactgttggcttgcgaacagggtcaggcccattccgcggcggattaggtcgattgtgaacgccaatccgaacatcgactgaacacgaaaacacacttcaaaagtagcaacttttgaagtgtgttttcgcatttaacgacccgcatcgccataatggccctcaccctaattacgatgcattacaattgaaaccggctcaacctgttacacatgaaagtctcaattattgatcctacttagcaacaacagtcgcgacttcttggtcgtgactcacttgtccacttgtggataaactgattttttcagcgggttgcccacctttatccacaaccaccaacaccgtcatatcctccccattttcagcggcctgctcttgatccacaaaagcgagtggtgtttctggtgtcacttggtcgccttcatgaacataagttgccggagttgcgctggtattaacacccattcgtaaccgtaccgtcagctttccagctgccagctcgatctcattttgttctggaatcagggcactgacggttcccgttactggactgaagatatggtggcgttctggtgtcaccgcaaaccccgtctgacccgcagcgactgtggctaaatctatcagtgtgccatcgactggtgcatataatttaacttttttaccaaatgaaaatagtcccatgataaaaccctcccgaatttgatgaatagatttccataatggcgctggccagctaccgttctttgattacctttatcctaactgctcgaacgggtttcaggtcaagggttttatttaatttgtttggttaatcgccattcttaatcggtagccgtcctttaaaattcagcaccgtccacggcgcattcacactaaatccttttttgcacgcccagctattcgccccgtatcacactttcccatgcgtctaacccaaaaattccccaccagcatttagccagtgaggaatcgtaacatatatgacatcctgagatgcccaccaccaaaacaatctaggatttggttagtgtttgattatcacgcggacaagtcccaatcatgttaaagcaaccaccgcacacgttggtgattcacgattgcattgacttccccggttaaatcctaattatctgtcgccgagtaacttttcggctgcttgtaagacattttcaccattcatcatgccatagtcggacatattgatgatatccattggaataccagccttatcagtcttcttcttcacgtcattcgccatgtagcgaacttgtggtcctaataacaagacatcgggatgcggatcttgactcagttgatggtcaatatcagccgctgaggtggcaaagatcttgtaatcaacaccatcttgctttgccgcagcttccatcttagacactaatagtgaggttgacattcccgcagaacatgccaacataataattttttcagccataattatttaattcctttctataattacatcttttcaatttcagcgttaccggcagcggcttccgcagcggccttttcgccttcttccttcgttaagatagcatcgtacttcttagcgaatgggaagtaaattgcagttgacatgaccaacgtaattgtttgccagatagccatcttccagccaccaatcaggaagccagaaatgattgctggggtcgtccacggcgccgcaaaaccattcaatggtggcacaatgccgaagtagatgaccagataagtggataaagccacgataactggtgtcaagaagaatgggattgccaagaatgggttcatcacgattggtaacccgaacaagaatggttcgttaatgttgaataatgctggcacgaattcaactttaccaatcgtcttaaattgaacagacttagcagcaaacaacgtaaagataacaagtccaatcgtaatcccagaaccagttaagttaatgaagttgttatagaattcattagtcacaatgtgggcaccctgagcaacggtcaacttacctgctttatataatgaagcattgtcgaacgtgtttggaatcaataacccactagtaatggcacccatgatcaacccaccatggaccccaaagaaccagaagaatggcactaagaacgcaataactagcgcaccaccgagtgaatcggataatccttgaagtggtgtttgaagaaccttgtaaataaattgcaacatgtcagtattaccgaaagcactgaaggccgcaaagattaacattgcaacaatcaagatgaccccggcaggaatcatggcagtaaattggttggcaacactagctggtacttgttctggtaaggtaatcttccaacccttacgaatcatagcggagtaagcccaaccaactaagatgccgacaataatggcagcaatcatcccttgaccacctagccaagtaatattaacaaccccggtaacgggtgcttgcacaaaatcttgtaggacttttggtaacttatcgatattttgtgaaacggcgctacctgacatcacgacattcccggcagcattggtgatcccactaccagctttacccatcgcagctactaatggattggcaatgttaagcgtttgcaaaagcaagaatacggccatggaagttaacccagcgggcagtggttcatacccttcgttacgcacatacacataggcaatcccaacggccgcccagagtgacagtaccccaaatgttaccgtataggcctggttaaagaacgctgcccaaccagaggccttgataacagcggccacagctgggattggaatattggacaagatcaagaatacggacccgatgataataaatggtaaggcgtagaccatcccgtcttgtaaggctttaactggtttagtgttaacgaacttcattattggcggtaaaactttgttgttaatgaaattgctaacagcaccattactactattttccattacaattcatctccattttttgctaggaccccttgcagccaataatatgacttcttaggaacccgctttaagtcttttagatcatgattactccggttaacgtaaacaaccccgtaacgtttttcgatatccgcgtgtgaacttggaatatcaatcaatccccagccgagataacctagtaccttagcgccgtcgatcaacatggcatctttcattgccttgatatgttcttcatgataagcgatccgctcatcatcttcgatcatatgctggccatcccaatgctcgcgtaacccaatcccattctcaatcgggaatacgggcacttcgtactggtcatacaatttggtaatcaagttgcggaaaccgagtggatcaatcgcccagccccattcattagcttgtaaaaagcggttggcctcaaatgaataattgagataacggttcgggacggcatcggcaggaattttatccccattgataaccgttgaacgataataactaaaggccaaaaaatccgctttcattttgccgatgatggcttcatcacctggttgcaaatcataatcgataccctgttgttcaacgtaacgcaggacttctggtgaatagtgcccgtgcacgtaagcgtcattcaagttgttgttcaagaactcgtcactcttacgggccgccataatatcaactggcttggccgtttctggataaaccggggtgtaagctaacataccaccaatcttcacgtcatcgtagttctgatgaacaaagtcatctaggcgtgcatgcgctaacatggtatggtggaaaatccggtataagtcgttaacactctgatcacccttggtatagcctgaaatgttgaagacttcgtcggtaaagtatagattatgttcattgaacacgatccaatatttaacccggtcagcaaagtgggcaatcatcttttcaccaaaacggacgaacgcatcaacagtgtggcgcgacatgaacccgttttcattttcagctaaggctaacggcatatcgaagtgatacaggcaaatcatcggtgtaattccccgcgctaacatcgcatcaaccagtcgatcataaaacgcaatcccggcggcattaaactcaccatcaccatctggaactactcgtgaccatgaaatctgaattcgatacatattcaaatgtaagtccttcatcaaatcaaggtcttcctcgtaacgatgatattcatcaatggcatcatgccaatccgaagtggttgcggtcgcaggacgaacatcataaactgaacggcccttaccgtcttcatcccaagcaccctcagtttgcatacttgacactgaattgccccagaaaaaatccttgggcatctgtcgctccttatccatcaaactcctcctctgtgtcatttattttggaaaacgctttcctcgtgaaataatactatcctatttctatttcaaaatcaatacttttactttaaaaatatatacttttgtgaaaataaccctatccggtcacccctaaagttgccaaaaaaagcggttcagcagcgaataacactgctagaccgctttgattgttctatttattcaaaccattcttaaccagcgtatcgacggctgctaatactgcagtatcagcagagcgcgcttgccaccctaacaatttctgggctttttgggtgctgacctcatgattgatgcggatcatcaaactagactcgcgtaattgcccattaaatggggctaatccccgcacaaaccagtctggaatcaaatgtttcgttaggcctgtagccaactgcggccgttgttcttgaatcaatgttttgaggtcccgcatcgagattggtgtggcggccactgctagaaaacgctgattggccgctgcaggtgccgtcatcgcccgaacttctaagtcagcgacatcgcgaacgtcgatgacattgactttaaggtttggcatcatctgcccagttaatatccgactaactagattataactacccgtgacgtgcccattaagcgatggcccaagcatggcgccagcattaaccgtcgtgaattctggactatcagcatgcgccttgcaatacgcccagccagcttcttcagcaaccaacttcgacttttcatacaatgaaagctccggttggtcttcgcgggtccagtccgcttcagtgacgggatgatcatgatccaaacgactgaagccaacggcaccaaggttggcagtcatgacgacccgcttaacaccggccgccgtcgctgcctttagaacacggatcgtgccgaccttggccgcactagtgacctcatcagaagcctgaccttgattaacaaatactggtgccgcaacactcatcacatacgtcacgtcacgcattgcttcggcccaaccctgatcctgtgtcagatccagagcaacaaatgtcaatcgatctaagttaggtgtacccgctagcgtctgcttgacaccagcggctttatctaacgaccgtaacgttgcccgaaccggatagcccgctgttaataattgtttaatgatatgactggctaagaagccattaccgccagtgactaatactaatgatttattcatgtttaattcccccggaatattggttgttttttccatcatggcttgttaatatagctaatataagccttagacaacactctaaggcaagtgttaggaggaatctttttgacctatacgattaaagaagtcgctgataaggtcggactaagtgcgtacaccttgcgtttttatgataaacaaggcttacttccctttgtcagtcgcaatgaatccggctaccgagcatttacagacggtgatcttcatctattacatacgattatttgcctcaaaaataccggtatggcaatcagtgctattcgccaatatatcagttatgtcatggcaggtccccaatcgattgcacaacgacgagagctgctgacgactcaccgcaatgctattcttgctcagcaagcccaaattatgaaaaatctggaggaagtggattacaaattaaacctatatagtgatccgcacgcgcgtgaattagtgcaagaggaaattgctcaagcgaagtctgaaaaacaagccctcggtttagcagatccatttccagtgacggaataaactgttaaatagccgtgtttgaggccattttcaagcactaaaagccgattatactaaaataatcggctttttttatggctgaattttgggtgatttcacgtcataatgttaattttaggcaaacctcaacttggttaacttagcttgtcactgtctcctatcaaacgatttaaccaacctttttcaaagtcacagttcggttacgaagattacaaaagtccgtattcttgtaatctttgcattgcgttcttaaaactcgcgacactaataagtaacacggaggcgttagactgggttctgttgattgcgaatgacatcgcagttaagatttttgtcagtaacttatttaatcgataatcacaaaatttataggagtgtctaatttgaaaaaacttgtaagtacaatcgtaactacctcagctgcagccgctggtttattattcgccggtgtcctcaatgctaacgccgactcaacttacaccgttaagagcggtgattccgtttgggccatcgcacaaaaattcaacacaactatcaatcatgttgaaacgactaataacatcaagggtcactacatcttacctggtcaaaaactatctattaagacgagttcaaccagttctgataacaacacctcgtcaacgacttcaaacacaacgagttcaagtgcttcaacgactagttctagttcaactagcaacacaaccgcgacgaccacttcaacaagttcaactgattccacgacttcaagctacactggtagcaatttgaagagttacgttttaagtcagatgcaatcacggactggtgtctcagcttcgacttggaacacgattattacgcgtgaatccaactggcaaccatacgtccgcaacagttctagtggtgcctacgggttattccagaacatgcacatcagcagtggttctgttgaagaacaagttaacgctgccgttgctttatatgaagcacaaggtatggctgcttgggccctttaatctaaaactattaagacaaagtcgggattccttcccgactttttttgttgcgttaaattactttctataatcaacatccttttaaacttataagaacaataccggtattaactatttaatattgggaatgtcacgttaaacattgtaattgccgctatttttgctaactggctcaactatcggtaatttcagtaattattatattttttaaataatgaaaaaactaagatttaaaccacgtgcaacctttaatgctgatctaaaacggttagccagtttagacaaatctattattgatgaagttcgagcagccattgacctgttgcttgagcaacaacaattaccaccagaatttgaagatcatgagcttaatcggcgaatgagcggttataatgaatttcacttacgagataccccgaaaaacaaaacaccaagcgaaactaacgatgtcctggtggtttatacgattgataaagatgaactagtcttaattggcattcgagtcggatcgcatgatcgtttatttcctggtcaaaatcgttccaaaaggtatcgaaaaaatgacgaataagagaagttatttataccatataaaaacaaataacccctaatatctatattatagatattgggggttattctttcaatgttttcgaggggcgatttggagattatagtccctaatatagggacaaagcttatttgaaagtttttctcaaacacatcatgtattttagactgtgccactattattctctgttatagggtttaatttagacagttctaatgaacatatctaacttaaatagattgtgagacacgaaatggccattaaggtataccctattggacgcttttgatccattatcaatggctttttaaattagggcctagtacttttggaatggaaatactttccaacaccaaaaattctagaccctcaaaaacttgaacatgattgttccgagctgtattgaagaccgtttcgggtagcgatttatcggtaacaatgtagttaatcgcgctcattggtgcactcatgtatagttgatgcttaccgattttagtgtgatccaccaacagcacaaccgcatcggcatgagcggaaaaagctcgcttgatattagcctctaaatcattggcatccctagattgcataattaaagttgccacccagtaaatgtgaaaaaagactatggcaatagtcaggtgctcatgtgtgattacacgcaggcaaaggagattaaagtcgtgcttagcgagattgctgatcaggttgctggcagacttcgtcaccatcaagtacaaggtgaagtggttagcgttgggattgattatgctgatgcagaagaagcgggcacctccggtttcggtgtgcaaatgaagatttatcccacaaatcacactgacgatttgagcccccaaaaaacgtccgcacgtccaaccgtacaattcttgtccggaccattgacattcttgccgaacgatttggcaggtcatgcacgaattaggcattcaaccgactatgtatcgcaaacgtcctaaaaagcctacaaccaatactgacacatcgcagaagcctaatttaatgagacatctagctgatttatctggggtcgttaccactgacatcacctatattcacctgatcaatcaaaactgggtttatctcgcaactttgtttgtcgttcctcggtcacatcaaaacaaattaaaacactggtaaaagacctgatgatgcgtgaatttaagaaatagccaagtgccttcgtcagaacgtaacttcttttgtccggcctattgacatccttgccgacgtagagccaaataaagaccctgaagaataataatattcttcagggccctctttaaataatctatattcgctacagatatatttatttaatggttaatcattacgacgtttcttgataccaagaaaaccgagtaaacttccaaacattgccaacaaaataccaataaatgacattgtttgactttgactattgttttcaccagtttgaggtaattctggtgaattaacagcaccgttgttaactttagatcctgcactcgtggatgtattgacaattctgctcttggcagaattgtttagttgacttgaattgccaagttgatcagaactaggcttttctgacccattgccagtaacagacgtattttttgattgaatggatccagtatctccagtgactttcccgccagcaactggattcttggtgtaaacataggttacagtctgatcttgagctgtgaagttacccgtaggggtaccttgaacttctttgaaggtatagccggcaatatccttttgggttgtcgagtaaggatcactaatattaccagaagaaacaacatcggtagcaatcgaattgccactttcatcaacatacttagctgtgacgtttccaccagcaactgggttcttggtgtacacataggttacagtctgatcctgagctgtgaagctacccttagggctaccttgaacttctttgaaggtataaccagcaatatccttttgggttgtcgagtaaggatcaccaatattaccagaagaaacaacatcggcagcaattgaattgccactttcatcaacaaatttttcagttagtttcccaacactgttccaaatagaagcaattggattgatagttaagttgctgatgttagtcgttccattatctgaatacacgtaaacaccatttgtagcttgatcaccaatattttctggccgcataaagaagttttgggtaatcgatttttcaccattattagcaaaggcctcaatacttgtttcgtcaacataaaccgtaatcgtaattgatccatcagcattcactgttgcgttcattttgtctcgtggtgcacccatgttgggttcaccagtgttgagtctctgaacgaaaaataatcccgtagttaaatcataaccaactaacatatcatattttttgtcgtcagaaacacgcagtttaaagccgattgaacttggtttattgctctcatcccaagaaaatgttgcactaatcttgtattgtttgccgtcatattgaactttttgatcagtacttgaaattgaaaaagtactattcttttgatcaataacgttggcctcttcgttgttagcaatttctttgatcacagtattcgccagcaaatatccgtctgttgtatcagcattctgttcgagagtcagttcgcgaggaagtgtcatattaccataccaaggtgttgtattagcttctcttgtataactccaatttgattcccaagccaacataactgttcgaccatcgggcatattggagaaaggaatacccgcataaaaatcctctcctgaatccatcgtcattggattttgcaacgtttttgaactctcaggtacccaagttccgtcggctgtcatattaccaacataatattgcatcccagatcctgtggcatgtgcgccttgttggacactgatgcaaaagacccactttgtttcatttgttccagctaccttcatcggtaccagtgatgggcattcccatacgccattaccaacatcattttcacgttcaatcttagaagcatatgtccagtccaacagattgctagatttataaatgagggcttgctgaccagacacaactgtcaaatagtattgtttgttaaccgcatcgtagaccacgcttggatcgcggaagttggcggaatctcctccttggttcatactggttggaatgattgcctggggattagctgcattaccatccttcgaatattgaataaacgttttgccaccatcgaggctgtaagccaaatgttgctcctgaatttctgttaaaccaatccacgtcccccatccgtcttcagcaccatcattttttctagtcgcgatctgataatcagcagtgtagaaagccagaatggcgtcttttcctaagccactgacattgttagtgtcaacaacaatcgagccactgaaaatagcctttttgccgtcagcgtcaccccaatttgttgttggtacaccaacatatctaacttcgcctttatcttttagcgaaccagttgtgttggtatacgtaaagtcttcccacccctgattctgtagcattggaatggcaacgtcctcttgtgtccagttaattaagtccttgctgacagcgtggccccaagacatattgccccattggttcccctttggattgtattgataataaagattgtaaagccctgtgctgctatcataaaagaggccatttggatcgttgatccaattttcattactggagtaatgaaattgatttctgtattgttcatcatactgatcgttttgactgatatcgggggttgtagccttagatgaattgtcaaccgctacagtggtagttgctttggttgcaattgttgtggaagatgttgattggtcagtttgagattgccctaaactactttttgcttgttcatcacttgtcggtgatgtggtattcgaattgacaatagccttatctgaatcacttgttgtaacatgttttgtcacatcagtattgttagtgctatttgaggctacttgatttttgtcatcatctgtctgactgactgtattactggatgatgcctcgctgtcgcttgaactcggcaaagcaacttgttttgatgatgccttgctgtcgcttgaactcggcaaagcaacttgttttgatgatgcctcgctgtcgcttgaactcggcaaagcaacttgttttgatgatgcctcgctgtcgcttgaactcggcaaagcaacttgttttgatgatgcttcagtcgctacgccattgactgaagacgattgagtaaccgactcatctgttgtagcatcgctagtctgagtgttgctttgactaatttgagaagacgcagcgcttgtcgcagcgcttacatttttcccgccattaaaaaatgaaacggtaagacatgttgataagcaggcaaatacccacatgcccttgcttttatacatcttgtagtgctgcttttcattaattttcaacctaattaccctcctgttttttaacagctcattcacatgactgttagtcaccactatttgttcttccaccacattgagctacaccaaaaaaattggtgagaactgaatctcaccgacttctcagtcctgccatagttgtacttatcactgataaatgaagcacctgcaattaaagtcacccgtaacaggagctatttgactttgggcgtaatgcctggctgctgacgaaccttcttttgaaaatatttgattttcttgtcatagtcgtcaacaactgcgcgaacattctgctgccctttccaacctgaatacccgaacatcaacatgcccagtgcacccaggactaggagcacaatgccaacgatgtttaaccacaaggtcttgccatggaagaagtagatcagaacaatgccaacgccactgagaatggtgcaaagttgaaaccagtagcctaggtttttcaacatatgcttctgatacgcaacttctttttcgtatcccttagtcatttcgtcaattgtcattttgattttccttcttccatacacgttcgtagtttagtaagacaggccagggttgaagaaaccaactaatacaccaacaagcgcaattactacgagaattaacattgtccagattgctgatacatgtttttttgtcattaaccaccaacaaaagaaggttacagcaaccgttaacaatcctggataaatactatctaatttatcttgaagatttaaaaacaccttaccattagccccagttaatttaagtgaagtcgtaacgcttacccatgaagctaaaacgccaccaacaaccatacttccgacggttccaatagcatgtcgaacagctgcaccttgtttaccaactaaaaagctaactgcttgatcaccaaacttatatccccgaaaatataaaaatcgttgtccaaaataagcaatgagtacccaagcaatgatatagaatattgcacctaatggtgaaccaccacttgacatacctaatgaaattcccaacagaataggaattaaggtaccgtcaattaaggaatcaccgatcccggcaattggacccattaagcctgcccgcatatcgttaatcgtttctccatcgatttccttaccatcagcgcgtgcttgctccatactagccgtgattccaacaataactgttcctaacattggattagtattaaagaaagcagtatacgcctttatggctttaacttgatcttcatgctcgggatataattttctaagaatcggcaacatagatgccatatatccaaatgtttgcatatgttcttgagaaaagcatgttagtgccccccaaaaccaacgatgaaatgactttgtcaatgtcttttgatcaagctgattatgactattaattttgtccatgatcaaatatcctcctcgtcgtcgctattacttggaccatcagcgacagcttcagatcctgatgtttttgccatctcaacttcatacataataactgcaaataatagcgaaataaccgtaactgataccaaattaagtttcaatgaagcagcaagcgtaaatcctactaaaaatgggatgaagtctgctgcccgcccaatgatttggcgaagtaaaatagcaatcccaacacatggtaacattccaccaactgtgaatagtgttttcattgctatcccatccataggcagtgcatttcgtaatgccgttaccgctgttgcaccataataagttaataacatggttggtaagaaagagaaaatcgcatgagaaatccatggccagccaaaattaactgccgtcagtttatccaacttgccactatgaacatctttccaaccaaaagattgccataccaagttcatagttgcgactgcgtaatacaaaactgttccaacggtacccaccaaagttccaactgattttgcaaggttagcagcactaccgccaagcggattcaatccttgagaagcaatggcgaccattgccaatggaataccaatataagaaattgcacgaacatcagcagatactgtcccaccgggtgtcactaacgcaatgtaaaccaactgcattgcaacaccacaagcaataccaagttgaagatttccaagaataataccacaaacaagcccaccaactaatggacggccaatagtgtaatttccaactgcttgaccagccatacaagaattcgagcataaacaagcaaacagacctaatagggctgcttgaagccagctaattgtcattttaaaagcctcctatcctttatcaatcattgatcaatatccgaatctcgatttaaatttattccaatcccctaatcgttgatctggtaataaagcaaattccacgttatagccattcttttcaatagcttcaaacgcatcaccctcagactgtgtaaaggattgattatctcctaatttaatcgcaccttcccgatcattacctggaccaacaataatcgtcttaatatcacctggtttaaaattcatatcgaccaagatctttttcatatcttgagggctcttggtgatgagaaaatacttggttgctgagttcaacaccttatccttaaccttgtcaaaatgatctaacgtccaaacgaaggtcttcttgtcagacgctgccatataggcttccttcaaaatcggattgtttgccgctttgtcgtttactgcaataattccatcacacggatactctttaccccaacggacagttataagtccatgaatcatgcgatcatcaatacgtacaaacgaaattgccattttgctcactccttaaatatcgtcatcgtcagaagcttctgatgaggtcgtctgaaattctttgatggccgcggttgcttctgaaaatgctttttcttttaacgctgagttatctaaactgtctttcgacatcaatgtatttaacgccattgggaagttcatcccgccaagaacaagcgtatcttgcagcttgccatggtcgttcaaaatgttgcaaaccgttgtgagtggactaccgccgacaatatctgccagaacaacaaagcttgcatcctctggcagggtctttagcaatgcctcaaaccgtgttccaaatgttgaagctgcttcatcgggttttaaaccaaccgcaatgacagaaccaatcgcatcatcgcccgcaaacatacccaaggtttgctttaagccactggagaaatcaccgtgactaatgagtaacaaatacttcaattcactttcctcctaactcaagaaatttttgaatatattttctaaaaatgatacctatcatcatttattagggatagcaccttctttatcattaaataatataagcagcttcgaattcgaactagactaaaaaatagttagcgcttacgatgtatatattaggcatatagatataaaaagtcatcaaaatattgtgcttaattttagacaatagtgcttaaggggtggaaattttgaatgcaatagaaaaactttatgcggttatcgcacaacactttccaactgaacgaatcacaactaatcaggctgccgatgcagtggggctaacacgcggcgtgaccagtagttatttatctaagctcgaaaagcaaggcaaactgctcaagaccggcagtagaccagtttactggcaagtcaagcgggaccattccgcttttgacgacttaatcggtgtccacggtagtttaagcaccaacattcagctggcaatcgaagcaatcgtctatccaacacatggattgccgatcttcatcaccggtccagccggtagtggcaagttgccatttgctcaggcaatttatcacgaagccattcgtcgtgaagtgcttaagaaaacagctgtgtttaaaatcattgattgtgccaactataaggatcatccagggacactcaaaaagaagttgcaaagtgagaacaatgcaacgacggcagatggcaccgccgaaagtggctacttgtatattaaaaatgtgcagatgctaggctcatcagatcaacactatcttttcacgcacaccaaccagcaacaaaccactgcttttcgttacatctattcaggaacaactgaaattttcaaagcagcgcgcgtctggttcaaaagtgcagcggttcagattaaactgagcgcttttagcgatcgacctttaaacgagcgcattacgtttgcggcgatgtaccttcaacaacaggctgatcaaatcaataaagagatcttgatcgcaccaaacgagttgatcaaactggcaaattttgatcacgccaataacatcacggcattgaataaccgtgttcagttgctttgcgctggcgcctatgccaaagcgcctgaccacacgcagctacggcttggtcaaaccgatacaagtgcgattctggtaacgcctaaacaacagaccttgcaagcaagaatcacatctttgatcaccagcgcgttgcagcttggcccaacaactgatgcgctttttaagaaactttctgactcgctaaacaatggcgagtccatcactgaacagaattttcttctggcgaaagtgctcaatcaagtcgataccattgctagtgaaaaacttctgtctgtatttgcgcaagccattcaaaaagacgctaaaacgtatatcacgcatgtatatggtgtaacgtttccaagcgacaatattttatggcaaaatgtggcacttgccttcgcattcgcgggtctttgtcgcgacaacttgccagacacacaatcagcactgaaaattcagaaagcaatcaagcaccgttatcctcgaagttactaccttttcaagcactttttgactaagttaaaagcgcagtatgttcaaagcccttactattatttgccattcttcatgatgatgattcattgcgaaagtaaaatcgaatcagtgcagtacaatgccatcctgcttgctcacggcgaacacaccgcatcgagcatccagcaagtggtgaattcgctttgcggtaattacttttttgaggcttttgatatgcccattgatgtgacacttgatcaaatcaacggttacgttcaggaatacctaaccgatcaaagtccatctgctaatggtaatattgtcttattcgatatgggttctttgcgccagatgttcagagaaattaaaaaggtatctgatcaagagctgattgtggtcaacaacgtaaccactgctatggcgctcgatattggcctgcgcgttcagcgtaatgatgccttccagtccatcgctgaagccagcgagcaatatggtgcaacaactgaagcccaatattacgaaggcttatcaaacaagaagaacattatcgtctcttgcatgtctggcgtcggtctgtctgaagaagtcaaaaagctaattgatgcgaccctttcgccagcacttgaagtcattgccgttgactacaaaaaactccataccctgctcaccaatcatgatcgaaaatttttctcgaatacccagttaatcttaaccaccaccgatgttgctggcgatatcggggccgatatcggcattgatatcgtgaatgtctacaatgtcttcgataaggcttcctcacaaaaaatgcaaactgtcctacgcaattgtggtgaaagcccccagtccattaatgaactcattgatcgattggttcgcttcttgtcgattgaaggtatccgcggccgcttgcagatcctgaatcccgatattgtcattcaagaaagtcaacgcattgtctcccactacgaagacttctacaacgtcaaattcggatccagactaaagctcaatctctacatgcacttgtccttaatgattgaacgcatgatgaccagcaaacgcagcactacttcaattgatcgcgcaaccttaaccccccctgagcaagaattcttctccctttccagcggcatttttcagccagttgagcaaaaattcaatatcaaggtgcaggactacgaaattgctttgctttatcaactgctcaaggactttatttttggataacaatgtgttgagtcaacttagccagttttacagagatctaagtaaggttgacaccaatggttcagcatattggtccaacctatatgctgatatagtaaatagtttggaaaataagcgtgataaaggggggcttttaaattcatataaaaagttcaataagttttcgtcaactaaacgactgtatcatgaaataaggaaagatattggagactttgaggatctaataaatcggtagattgtaaaattaatccgaacgctgttcggacaaaaaagatcagcttcctttaaaatggtgtttaccacaaacccatcttttaggagctgatcttttgtctagtctaacctattccgaacgaattaaaatcgaaaccttttgtgaactagggctgtccaatatccaaatgggcgttcggctgaaccgatcaccggcaacaatttcttatgaattatctcgatgtcaaccttatcaggctgaattagcacaaacagatgccgaatacaagcgatcacgatgtggtcggaaaactaagttgagcgatgagttaaagcaaaaaattctcaaccatttacgtctaagctggtcaccaggaatgattgctcacgaatttaaactagctactaaatctatttataattggctaaatcagaggagaattggtttctccttgaatgatctacctgaacatggcgtacgccaacggcgtaacgttgtacaacaatccaaatataatcaatctttggggcgatcaattgaacagcgtcccatgatgattaatcaacgtaagcgcatcggcgattttgaactagatacagtcgttggtcctcctgggcatagtaaggcagttttattaactttaatcgatcgcaaatcacggtttctttgggcataccggttaaaagatcggacgacagcgactgttaatgaagccctaactaagttcctatctacggtaagccatggagagttgtccgagtggctgaaggagcagcattggaaatgctgtaaacgggttatacctgtttcaagggttcgaatcccttactctccgttagttagatataataaatatgaccccttggtcaagtggtttaagacactgccctttcacggcagtaacatgggttcgaatcccgtaggggtcattatggaggattagctcagttgggagagcgtctgccttacaagcagagggtcacaggttcgagccctgtatcctccatctgatgagagttactcatcaataatttaatagactccatcatgaagaatgatatggctcggtagctcagtcggtagagcaatggattgaagctccatgtgtcggcggttcgattccgtcccgcgccatttatggaggggtagcgaagtctggctaaacgcggcggactgtaaatccgctccttcgggttcggtggttcgaatccactcccctccattctttatagggatatagtttaatggtagaacaacggtctccaaaaccgtcggtgtgggttcaactcctactatccctgccatgatggcggtagtggcgaagtggttaacgcaccggattgtggctccggcacgcgtgggttcgattcccacctaccgccctttgattgggttatagccaagtggtaaggcaatggactttgactccatcatgcgctggttcgaatccagctaacccagttgggtttgggcaataaatgatggcggtatagccaagtggtaaggcagaggtctgcaaaaccttcatcaccggttcaaatccggttaccgcctttcctgaaaaggttataatcctgatcagatttatgttccatctagttattattttgccggcgtggcggaattggcagacgcgctggactcaaaatccagttcccgttgagggagtatcggttcgaccccgatcgccggtactaagaggttttcaggaagctctaagtacctttaagaagtcgttatatcgttgatataacgacttttttgtattcttagaatcatgcgaaaataggcaaaatgatttttgggtgaactttccaattgaaaagaataaatttacaatattagcattgcatgaatatgaacgtagaaatagtctcgtaagcatcgaaaagccctgtattagcataaatcatgctaacatagggcttttcatattatggtaggtctttaaaacgaatccatccatctaaaacttgctcgttgcactcggtgataactgaagtagttggtttaagttcatggtgcttgttctgctttgtgactcgctagtgagttgtaatgtgtttctgaaccgcagctagtcaaataatggtaacggtgccaaaaaatcgatatctgttcgttcgctggcggcgccttctgctaaaattgccatctgcttgaccacttgggcgccagcttggtgtaggagggcgttggcagctgtcaacgagcccccactgctaatgacgtcgtcgataatgataacgcgcttatgattgattagtgcgacgtcagtaccgtctaaaactagctgttgtggggtgctggtcgtaattgcgcttaccggttcgataagcgggtgctgcatgtaatccttacgattcttacgtaaaacgataaagcgagggtggtttgtggcctggcttagtgcctgggctagcggaatgcccttactttccatcgtgactaaataatcaaatttagtggtagttagccgttgactgagctgacgggcagcatagccggtcagctcagcgtcgcccaatagaacgaaagaggcgatgctagtcgtggcatttaatcgaatcaatggtaactgccgtgtcagcgatcctaatgttaactgataagtttgcatatttataaccccaatccaattaatggtaaaccaaattttaggagtgccccggtcattagccccgcgaatggatcgacaagggcggtcacgacgagcgttacgcctgcaaccgtacttaacgagccgtgcaaagcggtggttgcattttccgggaaaatgacaatggtccctaagataaacaaaaaaccggcgattgcagtgctaggcacaacttttcccagctttggcagccatcccagtaatagaatcagcatcatgatcaacatcattaggatacccgcgattactggttcaggcgcgctggctgtcgcggaaataatcgtttctactggcgcaccacccagaaggctagttcccaggtctgctaatgcctgactactagtcagtagatttagattgaccgggttggggtgttgtcccgtcatttggccagtaattaagccgtacgagaggttagcaccgatattaagacaagctagactcagagcacctcgcaggattttaaaactgaactgtggcctgacaaattgtaatttgcgggtcgtcacatgttccggtagtgcgacgcgataatgtgtcgtcgctgcgtaacagctggttccaatcactgaaacggcaattgtccatactaaatctttactgatcaaataagtcacacccgccaagccgattgacagccacccaaattggggttgttcgtgcgccatttgcaacgcgattttagccaacatcaggccaactcctgccatcatcgctgccataagctgattgcccagactatgaacgatgagcggcagagtaccggtcaagccaatcacgaacatcagactcgcacctaaaaagataatcgacgaccgttcgcgtaaatcgtgtcccaggtgcccgactagtgcgagggattccgcttgaaatgaaaccggtgcaactgaactagccacgccgttgattaaaccaactaatccgaatgaaaatgcagtcggaaagaccgcaaaaccgagactcatcgccataattccttgtgggatcccgtttaaaacgaccccgattgctgccaatagatccgccaaccaatgcatattaataccgccttttttgtttatacgaataatatacgactgattagggtttaaatccagcaaatttaggataaaatcagaataatgttgtttgttaactatttatagttcgtgttttaacgaatcacgattagttggcgcacgctcgcaaatggggtatacttagtgctaattagtgaaggaggggtggcaccatgccaacgattaaagattattacttgccaaagcggccaacattattattttcgttgcatccagaaccaacacaagcgattatcaatggcaccaagattctggaatatcgtcggcgtttttttgcacgtccgtttcaagcatttgtctatacgacaggggctaatgggggaattcaactctttttgcgttgtgatcagggcctgcaactcgtgcctgaacaattagcgcttgtgggcgcattgttacagcatgacgcgcccacaaccaccgcggcttattttgaaggcgctaaagtcggattggcgttaccgattacggcttttacaaccttacctaacattccgttggcacagttacgtcgtcaatttgaaaactttgttacgccgcggagttatgtcttcttagatcagcctgaccggcaagcacagttggattggctattaacgcaaccctgtgagtcgctaactattttggactggcgcaaacggtatgcaacactggcgactttgttacaaaaatgaagccaagcttgtcttaatcgggctgcaactagtgcgccggttataagaatcaagcagccactcgttgtgcatttgctgagcaaaaggacttagctgtgacaactgccgcaaacgagtagtcatttagcatgactgattggatttgatcgtaaaaaaagaacctgccacaagtggtcaggttctcagattaattagagcattttttcatagacgtagcaaatgtcatcgacatggtatacaccgaccatttcgccaactcgcttgaagttcatctttgcaatcagatgttgcatcgcttgattgtcggcatgagtatcgatacggatgcttttgatttcaggatgatccgcagcaatatgagcaatgattttttcgaataattgagtggcataaccatgacctgcatggctagaatgaatcgcgactcggtgaatcacgacgtaaggtgccgtggtatttaaccattcggccttcgcagtatcgtaagtttcgtctggtgaaggcacgacagcgacagcgccgaccgttgcgttgtcgtcggcattgaataagtatgctgatccttgcatgatgtcggccgtgatttgtttgcgagacgggtagtcgccttgccactggttgaccccagcttcagcaagttgattacggccgtcactcagaatgtcgatgatcgtatcgagatcatcgagggtcgcttttttaaagtacataattctagctcctctcttgaacagcgattgactgccgaagcagtaatcgacttttaaaagtatacagaatttttagaaaaatgaaactattttctcccgattcttaggagattttcagtgacgattttcaagtaaaatcttgcgcgcttcttgggccatgtcatgttgcgtattataagcagcgaccgcactcggtgcatattggtaagtattagtccgcaaagtttgttcatagaattcgaagtagggtaagtgggtattttgcgcaatcgtgatagcacgctgccaatcgaaatctacggcgcggtaatcaacatgctggaggccagtctcatcaattgtcagaagcaagtagtttgctcgtggttggcgtaggtggggattaatggcagtcggaagaccaactgtcccggcgtttagaatcaactgtcccgtggttgcgtagcgcatgatgggctggtgtgtgtgcgcgtagatgacgatatcgacatcgccttcagcggcttggtcaaagttggcctgactggcagttggtgcgagcgcgtgtccactagcgacggtcggtaaaacgtgttggagacggatggttaacgggccgacgtgtttgatgactgtcattggtaagttcagtaaccgttcaaagtgtgtcgaactcagctggcgccgatcaaaagcggtgagaaccgttgccataatttgtttgggtttagtaaacgtgttgggattggctgccattactttttggtagttttcctcgtgatttccgagaacgtaggcggtggggtgaacgcggtctagtaaggtgagacagcgctccgattctggcccgcgaacggtcatgtcgcctactgtccagtattcgtcaacgtgttgtttctgggcgtctgctaagactgcttcgagtgcagtagcgttaccgtgaacgtcagataggactgcaatttttaccatgttgagatgcttcctttctactatgtaatctaaactctggtgagatgttttattctggtaaacgtgggttttaaaaatttatgaatgtaaccactatgaaaagccatcgtaacttttatctgttataatgggtatgaaacgaagtaatatatagcacgtatattcaagccaattcgtttcgtgccgtggttatccttgcgataatcacggtttttattttaccatagtgccttatgattagtttggttggtgtcatttaattgtatcagtacatggaatgcgggtgggttaccacacatgtaattgcccagagttcaaggtgacttacatatggtgtgatattgtttaaactgaatggattgcttctaaatatagtggttaaactaattgtttgtgaaagaggttttggataaatgatgacaccttacaaaaaagttaacgtaacggatgcgcctcgactaaagctggcaattaatttgactagtgtcttgttgtcttttcaatgttatttagtaatatgattcgagccagcaccattgatattgggcatgtagcttggctaaaatggtcattttagcaattgggactgttgcgattcatgggtgcgggttgtactggggaatttttacctagcatagcaactagtgataacgttgcgatactgtctgatagaagatacattgcggggtatgactatttatcgctaaaaattgggaaattagtatccacgataattgagttggagtatcaaaaggccatcaacctgcgtatatgcttcgcggttgacggcctttagtttagtgctgaagtcaaagtagctatgtgaatggatctcatctcaaaacaagctatacaccaaataaatattcaacaccgtaataattccggccagtccatatcccacccacgttaccgccgggcgattaacgtgggccttcatcaggctggcgtcatttgtcagcgcaactagtggcaacaaggtaaaggggagggcgatgctgagtgccacttgcgcgtaaatgatcaagttttcaaaggcagcgtcactaaagccgactaacataccgataattagaatcggaattagcgtgacagcgcgagtaagcagccggcgttgccatagcggtaagcggatgtgtaaataaccttccatgacgatctgaccagctaaggtgctagtgatggatgaaattaggccggtaattagtagggctaatgcaaataaccagctcatgaccgggctagcaagggcgccaaccacggtggtactttttaacccatcgaagacggcctgcagactcgctaacgcgttggtgtgaccgaagaaaagcgtcccaccaaggacgagcaaaagtgcgttgatgagaaaagccgcaatcaagtgcactgttgagtcccaattggcgaagcgcagtgcttctgtgacttgggctggattatgataatcataacgccggctttgtgcaagcgatgagtgtaagtataagttatgtggcatgatggttgcgcccaagattccgagactgaggactagtgcggtatgatttttgacgatcaatggtgttggaactaagccgagcaacacgttgccaaattgaacgtgggcccgtcccacctcgataccaaaaataatgccgacggtcaaaatagcgacgaggacgattacttcgacacgccgaatgccaaatctcaaaaacaacaagacaactaagacgtccgcaatcgtcagtaaaattcctgcaagtagtggtaagccgaataacatttttaaggcgattgcggttccaattacgcccgtcatatcagtcgccatcatcgcgacttcgtttaaaatccacgcggcgtaacgcacgggccggggcagcttgctagcgatggcttgtgctaagtcttgccgggctacaacgcctagcctgattgccaggccttgcatgaacatggcgacaatgatggctaatgcgagcacggctaaaagccggtactgaaactgaccgccactggctagggatgtcaaccagttgccgggatccatatagccgactgccactagtgcaccgggaccgctataggctaaaaatttgcgccaaaaggccgtctgatgaacgtcgggaaccgcgacgctctgattgatttcttcaagactttgatgacgatgtgattgcatggttcgacgcctcctgcttttggatagcgaggtcagccagaaattggctgaagccggtatccttattcatcggtggtactaagtcaaaccgatcaccaccgcttgccctaaaggtttgataattttgaacgtagtcttcctcgagggtttccaagcagtccacgacaaaggatggcgtaactactaatacgttgcgtttgccaagttcgaccaactgcatgagctcattttttaagtaaggcttcaaccacggcatcggtccgaacttggactgatacgccgtaatgaccttatcagctggtaattctggtcgctccgccaacacagctttggtcgttgcctcgcattctcgttgatagggatcaccatggcggaccattgcagtggggatgctgtggtagctgaagatgaccgcatcataatgatgcgcctgatagctttgccagactttggttgctagtaagtgaatgtaggtcggttggtcgtagaaactgtcgataaaggtgtgtggtaatccagttgcttcaacttgacgatggatgccgccgtgcgtgctctgggtgtattgcggaaaaagtggtaaaataattggcttttcacacccatcagcaaccatggctttcaaggtcgcaccgatatcgggttgaccgtacgtcattgctagtcggacgtcccaatcgggtaatgctgcttgtacttgttggcagatggcttgactgtagacgattaatggtgagccttgtgggagccaactatcctgataaaaggtggccgaacgccaagaacgggtcggtaagataataccacgcaacagcggttgccagagtgcggctggcatctcgatgacgcttggatcacttaagaattcttgtaagtatgttttgacatccttagtccgtggggatgctggggagcctaaattgacgagtaataatcctgggtgcatagaaacccctccaatgttcttgataaattaatcatagcataatcgtcagcttgtatacggggttaatgttttatttattcgattatctagtgataatcaatttactgctgaaataaataaaatctcttgctagcaactggccgggctagcaagagatctgaaattgatatttggttttgttgcagttcaaaaatcggtgtcgtcggctggatcgtactttaaaagtagattcagaaatgccagcaaaagccatgaccatgttcgtttttaggtcgtcaacatcaaaaggcgattactgggtggacttggtgagttgagctgactaacgggcttactttgcggcgtgggtccgtcgataacgttgattgagatagtagcctagatagcaaatcgccacgaagggaatggtgtaatacaaggcaatccgctggttagggtcaaaccaaatcaagatacaagagagcccacttaagataaaggccagccacgggacgaccgggtagccgggcgttttaaaagtcaattgatcaagcgactgcccacttttcaggtaggctttgcggaagttgatctccgaaagggcaattgccatccaaacaatgacgacggcaagtcctgaaatggatactaagaccaggtacaccgaaccggcggcatagacactcgacaatagggccagaatgccacccagcatgctagtaattagggcgactaacggcacatcgcgcttcgtggttcgtttgaaaacctttggaatggttccctcgttcgcaagtgaccacagcatgcgggtagacgcgtagagaccagaattagcggccgacataatggcggtcaatacgacgaaattcatcaaatcagcggcgtagggaatcccaatcgctttgaagacgagcacgaatggactttgcgtcacacccgcttgtttgtaaggaatcagtgcggccatgacgaacatgctaccgatgaagaaaataatcaggcgccagagggtcgttttgatggcggtcggaatggtgtgggccggatccttcgtctcaccagctgtaattccaattagctcagttccagaaaaggcaaagttgaccgttagcatcgtcgtaaagacgccaccaaaaccattgggaaaccaaccgttacgcgtatagttgctcagaaacggggcactggtatgaccgtgaagtggcaggataccgaccattgccagtccgcctaacacaataaaagcaatgattgcgatgaccttgatactggcaaaccagaattccgcttccgcaaaccagcgtacggagagggcgttaaccgtgaagatgaccaccataaagacgaggctccagatccaggtcgcaatgtgcggaaaccacgtttgcatgatgagccccgccgctgtaaattctgaaccgagggcaatcgtccaagtcaaccaatataggatggccactgtaaagcctgtgccaggaccaatatacttcttcgcatagacgtgaaacgccccggtgtagggcattgcaactgacagctcacctagacagagcatgacgagatagacgaggacggccccgatggtataggcgagtagggtcccgattggccccgcttgatgaatcgtgtaaccggaacttaaaaataatccggtcccaatcacgccaccgagcgaaatcatcagcacgtgccgtgattccatctggcgactaaggtgggtttgttttgacataatgtaccggccttccttacttgcagaattaatatgattagactatgattagaaaatcaacaatgctattagaataacataatttataagtagaaaggaaggcaattattgcaatgctttcattaactgaacaattgaaccggggcccagtcgtctcggacggtgcgatggctacggaattagaaaaacggggcgtggcaaccaatagcgcactgtggtcagccacggcaatgttggaccacccggatgcgattcaagcagtccatcagagctatctggatgcgggcgcaaaaatcatgacaactaatacataccaggccaacgtccctgcatttgagcaggctggtattgctgccgcacaagcgcgtcaattgatacaacaggcggtaacaattgcgcatacggcgcgtgctgctagtcatgtcacggatgctgtgattgctggtagtattggcccgtacggcgcttacttagcggatggtagtgagtacacgggtgcgtaccagttaacgccgagtgcctatcaggacttccaccgcgaacgtctggcgttgatcatggctgccggggtggacgtgcttgcattagaaacgatgccacgtttagacgaagtacaggcgttggtacaactaatcacaaccacttggccgcaacaaccatactgggtaagttttagtatcaaggacccccagacactatgtgatgggacgtcgttagccgcggccgcaaagtgggtggcggcccagccgaacgtggtcgctgtgggggtcaattgcactacgctggaaaacattgcaccagcgttagccactttgaaggcggctgtagcggttccgttgatcgtttatcctaattctggtgatcaatatgatcccgtgacgaagacttggcaagaaactcatttgagtcaccaattcgcgtcctttgttccccagtggttagctgccggggcccgcatcatcggcggctgttgtcggacaacgccgaaggatattgcgacggtggcacgggctctcagtgtttcggattccaccaagctttgaaaaatgttaagaaatgacggtgttttagttcatggtgggcgtgtctcagagatctaagttgtcttgggtgtttgttacacactaattatatttgagcaaaacaataactagcgtgctgagcgtcattaggtatggctagcaatttaattgaaactggtgaaaaatcactagtcgggcactgctgatacggtagttgttcacgactagcgatttttgtatcctagaaactgtaggacgcgcttttgagtcgttagatgtgttattttgtggtgagcgggccgtcctggattaggtgctgtttttgtcgcaggtcttgtaaatggtgatgaaaatcatgtgcatacatgactgcgaaaagactgtctaagacgtattcaaacgccgcttgggatgcgaaagtaccaattttggcaaaattatattcactctgaacggtgagcaagtgctgggtcgcttgactgatgagtggtgattgtggattacctgttaggacaatcatgggaatttgatgagcgtgaaaataggtggcaacttgctgatggattttagtagtaccagcatatgaaataatcagagcacaatcatcagctgttaagttggctgcgttccaggattcgtcagcatattcttcggcgattatagcaaaacgattgattttgacgagtttattttgaaaactacgggcccgtagttgtgagtcaccttgcgagaagataaagattcgttttgatcgcgtcaataagtcagcagcttgggctaattggttcgtatcaagttgctgctgggctgtctgaatggcccgaatattcaaggcggccatcttttggctgattgtggcgaccgaatctgtcgccgagaacggaaaattggcatccacagtggcggcttgatgtgcctgggcaatgctttcggcagtcaattcccgttggaaatcgcgaaagccccggtagttcaatttttgggccaacctaatgattgctgaatgggatgtgtacgtcttagcggctaggtctttgatcagaatagttggcatttgatctagatgtgccagaatatagctactgatccgctgttcagtactagtaaagtctgactgttgttgcaaggcaattaatattgacatgtcatcgacctccatagttagtatcatacggttaatattggaaaaaagcgacgattatcataaaactgagtaaaatcagcttgacctggtaccggtttcataaattatggtaattatatgaaacaacgtggtatcatcaattgagagaggaagttctgtgatgacgaatattcatgatattgcgcgactatcgggttattccgtctcgacagtctcgcgggtaattaaccatcagaagtacgttgcggatgataaacgggccaaagttgaggctattatgcaagaactggattacgtacctaaccgggtcgctcgtgatttaagtcgggggcggacgaagacaattggcgtggtactaccgtatgcgaatcacccgtatttcgcacgggtagttgatggtatcgtcagtgcaggctttgcggcgggttataaaatcatgttgctaccgactaattatgatatgacgattgaacgccattatttagaagacttacgaagtaaagcctatgatgcgctgatttttacgtcacgtagtagttcactggatacactggaacgttaccgcaagtatggtcaaatcgtctgttgtgaagatccaggtgatgaccgggcattggccgcagcttatacggaccgcatggcttcatatgttacggcattacggtgggcgaagcaacaaggttatgcgacgatgggcgttattttgagccgtaataacgtcgttagtgctagtacacgggttacgcggcgagcctaccatgaagtatatggtcagttggatgacgagcgactctataccggtgctgccacttatgaagacggttaccacgctggtaagtattttgccaatcaagcgtctcgcgtggccgcgatttttgcaaatggcgatgatattggggcgggcacctatcaatattttatggatcacgggttagcccccattccagtgattggacaggagaacttgctgacgagtcgactcttgaagttttcgacgatcgaccatcatctagaatcattgggtcagtcagcatttcgattggcaatcggcaagacccgcacccatgaattaattaaatcagaatttataccgcgataacttggaggagcaattaatatggtagcaagattagcagtttttgacattgatgacacactattggctcgcaataagcagttattaccgagcactattgaaagtattcaagcacttagagatgacgggattcatgtagccatcgccacgggtcgcaatttagcgatggcccggccagttattgatgccttacaattacaagattatgtactgtgcaatggttcagcagcgtttgctggtcgccaacaaattcatcaacacaccttatctaaagacaatgttggcaaattggttgcggcggcggatgaacagaatattgatattgtggtcgaatcactggatgggctacatatccacacacatccgtccaccacgacgcgccaggtgttgaacacgtttcgggcacctgagttggattatgcccctgattactatcagcaccatgatgtgtatcaggccatgatgttttacccggatgtccaaaatcgattgttgccgcatccagatgagttttcctttgttcgttttcatgaacgcggggttgatatcattcccaaagtgggatctaaggcgcaaggaattgcaaaactggcagcggcacttaatgtcgattcgagtaacgttgcggcctttggtgataatgataatgaccgagagatgattcagagcgccggtattggggtcgctatgggtaacgcgaaagctgagattaaagcattagcagacgttacgacgaccgattgtgatcacgatggcatcgccaatggactaaaaaaaattggttggctataaattttaatgaaataaaactgtgatccaaacagttgacttgcggaattcggttccagcaatcagtatgttggggtcacagtttttgattagttatcgcgtagcatcttcttgatcgccgctactgaacgggcgacttgttcaggatcaactggctttttttcagctggtgtcgggcgcacagtggccgactgattagacttagttggtgttgggttcgacatagtcggctgtggcacactagttttagttggctgtggactaattttagcaccagtcgaggcttgagccggctgaccagcgtgcatctgatccatagtctgattcaacaaatgatcgacaaagacattgccctgattggtagcgtggcccttagtccagcggtaattgagtgcagtgaatgctggaagcaaccggtcgacttcacgccataactcggcgttaactaacggcccattgctgcgtttccagccgcgtcgtttccaaccagccagccagcccttggtgattgcgttgaggacatactgtgaatcaagtacgaacagaatcccagtcttagtttggccaagctgttgcaattgttcaagcgctcgtaagaaggccatgatttccatacgattattggtggcaccccattcgccggcagagtcagtgacaagttggtcgggcatttcaatccgataagcccaggcagccttatcatcttggtgcacgtgctgaccggcaacgtttccggtatttcgcgaaccgccatcagtataaacagtaatggttgcgttgaccggcgcttgattagatattgattttgagtgagctggtcgggttggactgtccttaccagccataaaatcctgagcgtctttctcgcttgtgaagctcttgtactgtgcttgtggataaccgctaacttgcttttgagtttcgggccaggtgcggtaaataccaggttggcgtcccttacgaacagcgtaatatttttgtgccatggcgatacctactttctgaatggtgatactgctaatttaacataaattgccggggaaaaatgaaaaattagcagacttgtaaataaataataacaaccggatcacggaagcgaacttctgtgatccggttgccatgatgaaatataactaatgggctttaaataatgtcgtcaggtaattcatgaatgtcttcaaataacgatccttgtcgaccgttaacgcaaccgtgacgttagttgggtcattgagtcgcgcagggtcaccaattgtccggccataatcttcaccactcgcttggacgtacatgtttagatccaacgttgtgacaaaacttggatcgagtgaaacgccgactgccagtggatcgtgtaaggcacaaccgtgtaagtcaggactcgtaatatcgtaagccgcaatgtaatagtcaacaatgtcagcaaatttttcgcccgcagttgtctttaagtcccgccattgttgtgtttcagtcttggttaataatgtccgtaacgttacgtcgagtccgaccatcgtaagcggcatcgtactggtgaagacggcgttggccgcttcggcatcttgattaatattggcttcagcgtagtgactgacattacctggaacagtcagtgcaccacccattaaggtcacattaccaatggtgctggcaatgtctggtgctttttcgagtgcttcggccaagttggttaagggaccggttggcactagagtcagatcggcgccatattggtgaacggcatcaattaagaagtcgacaccggactgcttttccacggcgcgtttcggttcaggaaggttcacgtcgccgataccgttcatgccatgaatctgctgtgaaatcggcataacgtcaaagtgttccgtcgtactggagtggggttcacctagaaagacgggtacgtcagtggcacctagtagttctagaatttgtaaactgttaatcgccgcctgatccactaggcagttcccataagaactgataatcccaattaaatcaacgtcgggtgcaccgactgcgtaggcaatggccattgcgtcgtcaatcccggtgtctaagtctaaaatcattttacgttttgccatgtaaaacatcctccctgattaggtctgaagcgctataaagctatgttttaattgtaaacgtttcagctgatgctgacaacggctagcggcgaattaaattaacattgaacagaaaaatgttcggaaatatttcacgaccacgcttactggcgaaatgttgaaggctgttctatactgacaattaaggaaggtgaagctgatgacgacgaatagtccattagaagcaatcatgaatgcgcgccattcggttcggcaatatgacggccaaactaaaattgggcgtgaagaaatgaccgcgatgttacagaccgcatttttggcaccaaccgcgttgaatcaacaaccgattcgggcgttggtgattgaggatgcagccttgcgacaacggttgtgtgccgcgactggtaataccagtcagttaactacggccagtgccgtcgtcttatttgtgctggatcgtgaaaatcaacaccaagcgccagcgtttcaggccagtcaggggcaacaatttgatactggtgacgagaccattggcgccctagatgctggcctgattgcgatgcaatttatgttagtggctaaagatcatggctttgatacgaatccgatgaccgggtttgatgctgccggattcacgtctattttggaacttgacgcccagcggtatcggccactattgctcgtttcaattggcaaagcggccgttgctggcaagccagcagatcatcaaccgctagcgacattagtcgattatcgataaattgaggggaagctagaacgtgaattttgaaaagcactaccgatatactggaaatcaaaaattaggattaactaaattagcaacggcggttgatccagaatttgaagacgaaaaggtcatcaaggcgcaaatcgccaagaatattaagcaactgactgaactgcaaggtaagttatatgcacaagaccgctttggtgttttagtcatttttcaggcgatggatgcggcgggtaaggacagtatgattcgccatatcatgagtggggtcaacccccaaggctgtgaagtcacatcgttcaagcaaccaactactaaagaaattgcgcatgattatttatggcggattcatgatcgggtccccaaacgcggcatgattgggatcttcaatcggtcgtattatgaagacgtacttgttagtcgagtccatccggaaattattgtgaatgagcacgtcggtgagattaacgataagaaacaagtggatgatgctttttttgaacgtcgttttaacgatcttcggtactttgaagattacttgcaacacaacggctacttagtgctcaagttcttcttacacatgtcaaaggcggaacagaagcaacgttttattcgccgtattgaaattccaagtcacaactggaaattctcagctgccgatattcaggaacggcagtattgggatgattatcagcgtgcttatgatgatgctatcaccaagacggctactaaagcgacaccgtggtacgtcattccgtcggatagtaagtggtattcgcggctctgtgtttcggaaatcatcaatcaacgcctgtcggaattgccattagcgtatccctcactggatgcgagtgcgcaagcacaattaaaaacggcgctggagcaactagatcgtgagaccgactaacaaagtatcgcgcagtgttactagcagcaagttgaaattataaaaaatgagctactcacaccgttgatcgtcagttcaacgcgacgtgagcagctcatttttttgacggtgtgacaagctaattatgaatgccgatgcttagttcggcgtgtcaggacaaaagcgctaccgagtaatccaatcaatagggcgagaccgatagctactgaccaacttgccgagtgttcgttagtttgtggcaacgacttattcatcggtgctgagcctgcaaaagctgtagctgccgatgctggtaagggattagttgccggaaccgttgtggcggtcgtgttagtcgaatttgtcgctggattggcaggtgctgacagattaccactgacgcttggttcgggggtcgatggagacgactcatttggaacggctggagtgacggccgttggtttttcaggtgttacggttcctggattggtgggcttaggaccactcggctgttctggtgagacggtacccggcttttctggttcagtgattccgggtttctccggttcagtagtcccaggtttttctggttcagtgaccccgggtttctccggttcagtagtcccaggtttttctggttcagtgaccccgggtttctgcggttcggtagtcccaggtttctctggttcggtgactccgggtttctcgggttcggtagtcccaggtttttctggttcggtgactccgggtttctccggttcagtagtcccaggtttttctggttcggtgactccgggtttctcgggttcggtagtcccaggcttttccggttcagtgactccgggtttctcaggttcggtagtcccaggattttctggttcggtgactccgggtttctccggttcagtagtcccgggcttttccggttcagtgaccccgggtttctccggttcagtagtcccaggattttctggttcagtgacgttaggtttctcaggttcggtgactggccgtgaaatcgaggccgtcgcggatcccctgttgccgttcttgtcagtataggtgacatcgttttcaaaagttgcgtcgccagtgggttcgttagaactggtttggtaggtcaatgctaaccctgacgtaaacaatcctgtggcactaaacgtcaattgattaccattcacgctcgtattaacgggaatagtattacctgtcccatcgcgtaggacggcgctaccagtgacatacgtttggttcgggctcaacgtatcaacaaaggtgggatcgacgagctgattgttattaggcaaaacacgaattgtccagttgatccgccgtggattagcttcgtcagcccattcagctgatttctctaataaaattggggctaagttaccaggatgactaggaacggttccgaaggcgtccaattgaacaaaccctttccgattacgtggtctggtttgataggcctgattaaatgtgacgagacccgtatgtgcgccggcggcaatgaagaaggttccgatggtacctgcagtggttcctttcattggaaaagcctcgtcatgcggaatacgaacgttttcggggacttggaaagccattgtgtcgcccgccttgatcttgaggttatcggggatgcgccaattgtaattgaccgtgtattcttggtcttctggcaattgtgcatcgtgagccattaccttgcccttgctatctttgataaccgcactattaacatcgttgcccgttgcttcgattacgttgcgggcctgactgactaatggtggcccgaacatcaaaaagaaaattccagtaagtgctaataatagccatcgccattttttgcgcatggtaatcgcctccattaagatatacccatacattaccacaattgtacatggaaatcgctgacaaaacaccgtttgctagcttaactaacggtatgcggccagatttagcagacttttttgtgattgcgttattaactgatatgtgatgttttaggataccagaaaagacaccatttgccatccaatccaagggacgtaagggtgtccgaatcctgttaaattagaagtgtggcgtgcttcaggttgattggcagcacacctcgatgaattgatcagttgccgtacaagaactggatgatgagtaagtcgacctgtgaattgatatgcagcattgagtggctggcggtcaggggactgccgtgaatgattttggttttgggtgaccaaccagctgccaataattgatggctgaatttaagtacggcttgtaaattgacgccgccatcaccacttgtatgccaaacatggccggcaatattcaatatcggcaaggaccgtggtaaccagcctaactgccgagtggtcaagcccggataggtcgagccaatggtcacaaacttattgatttgtgcgtgttgaggaacttgcgctgtcagataatcaaagatgatattacctccagatgagtgaccgacagcattgtagtgggtcacatggtagcgttttgcgagcacttgcatgacagtagcaaactgccgagcttgacgtttcgcatgatgattatcggcaaagataacctgaatcgttgggttgttttttagtggtccgaactgttggacggtcacgtggccggcgtgactgacatggacgaccaatccttttgtcatcaggtgtgccgcggttaagcggtgcacaaagccgtcggtagaaaatgcgcgcgcgtaatcgccaccgacgaagatggtcggaatactcgtttgggcgacccgcgtttttcgtaatggggtcaagcgatgttgccaataggatccaatccctacgaccagggtcgcactaataatggccatgattttaataattttaattcgtcgcatcactgatccacctcgcctttgaatcctattatagtcgaattagtaaaaattgcttttgcaaaccttcgccgaatccactagaatgagaagcaataagtctacatagaagagagctgggaaacgatgagtgcagaatatgatttaacaattattggtggtggcccggtcggcatgtttgcagccttctatgctggtatgcgtaatgcgcgggttcagttattagaaagtctccccgaattagggggtcaggttcaggctttgtatcctgagaagatcattcatgacgttgcgggatatccggcaatcaagggccgtgaactggtggcacaacttgaaaagcaactcacacaatttccaattgacattcaattggcgagcccggtgacggatgtcacgggagcgatgggtgatttcacgattaccacggcgagtggacagcagtcacattccaaagcgattatcgtagcaactgggagcggggcttttgaaccccggcgcttagcagtcgataatgcggctgaatttgagaataagcaattattctatcacattccaagtgtcaagcaatttgcggatcgaacggtactagttgcgggtggtggcgactcagccatcgatatggccttgatgctagaacccgttgccaagcacgtttatatcatgcatcggcgtgatcgattccgcgggatggaacacaatgtggacttgttaaaagcgtcttccgttgaaatcaagacgccatttttgattaagcaacttgcagagacggctaccggacagttacagctgacgatgaaagaggttcgcggcacaactgaagaaacattggccgttgatgatttgattgttaactacggctttatcgcggataataaagtcatccgaaactggcacgtgaccccaaccatggcgcaccgactcatcaccgttgatacggagatgaataccgacgtacctgggattgcggctattggtgatacggtgacttacgcgggcaagttaggcttgattgccagtggcttcggggaagctcctaacgcggtcaatcagttaatgatgaccttgtatcccgaacgacggagtccactgcatagtacgaccgtgtttgaaaaaatgtaagtttaaaagagctgcgatatatacaagcaaataggacgagaaaccgaatcttggcttctcgtcctatttgcttgttcctttaagaacccgctttattggcggcctgttgtaccatgaagtggtagaaaggcaaatgttttttttaatctagatagctttggtgtgtcttaaaataaaaaaacaaccggtcgctccggctaaacttttacaatgtataagtttgtacaaaaaaatacacaaaatttactgaaaattgataacgataaagaaacgctgctgttaagataaattcgtaacatactgcttgttgttaacgtagaatttgagaggatgattctgtttatggcaaaaggttccattattgatggtgtgttagtttagatgattagattttatatgtcactagatgttgtgaagcatacgatactttatttgtgctttatttttctattactgtatatctataaaatgagttaccaaatagtacaagcaaccataagcgaaaagtatgatagcttgtttgaatagcgtcgattggaaaatcagcatgagcaactcattcgaatatgaagacattaatttagaaaatcctttctgaagtcacctaagtattttagcttagatagcagtatttaataaaaaacgttgtgtctagatttctcattgaaatgaagcacaacgcttttggtattagaaaataaatgattatacgcctgaagaataacactattatgattcatcaggtcagacaagggttattgcccatgcacctgctttgacagcggagattaaattcaggcgctgtaagtggaaaacctgcattattccaataaatttcgataatagttgaaagtatcattgcttgatctagtatataggtagctgggaactaagaacacccgtggctaaatataataatatgtattgtgcgtatagttgaaattcattaacataatctgcaaagtctattgaatgggcacactgcatctcatacgatataaagcaggtaatgttcacacttttatttaaccaaaataacgtaaagacataagaattttcacgtccttcttattgtgcctatcggatatttccgtagctaagtgggctgatttgattgactagactcgtatcaataccattgtcctcatcaaaccgtataaacaataattaacctcaattaaaaaaagccatgcagccccattcttacagttacgacacagtaagaatcaggcttcatgacccataacacgattcaaatttaaccacgcggcatcgattggcaggaacacctgtcaattgatgcccaccgcacggcccaatcaaattgacactagccacaccttttcttacaaggtcagcactaactattttggtccaaaagtgaacccctttttacaatccactattcttcaatctgaacaaagtgtgtgttacctagtccaccgccaacttgcatgacactgccgccatgccgaagcttgcccaagttaacggggcggaaattcaacggccggacgagcgcagcgaattctttcttggcagcaacgtcatcgcccgcatagaacaagacccgctttccaggcccatcaacgtgcccatccataaactccggcggaatcgtattgaaggctttaatgacccgggcattgttagctgcacgaacaatgacttcacttccagtcaacggggccgtcttaattttcttaaagtcggccgtaaactggttcgtcacgtccaccacgatccgttgcttataatcggcgacctgcgctaatactgccggcgcctgttcaaacggcactgcaagaatgactaacggttgttgtaaggcttcagcaacttctacaaaagccacattggcagcaaactcggcgcgccgtgttgctaaactagccgcaccactgtgccgacttaatttgatttgatgatcaccgcgcgcaaaggtcttggctaatactgtgccgaccgtaccggcaccaataattccaatttccataactatcctccacctcatcttttaataatggtttgaattaaccaacttatctggtccgttatcacggactgtcaacggtcatctagaccaaaccagcttatcttaatgatagcgaaatcattatggaattgcaccccatacgcgtcaactatgcttgaacttgttggtaagccgtaataccagcttttaaccgtgccaatccatccgtcagggtagtcgttggacaagccacattcagtcgcaagaagcggttgccatcaccacggtaaacatctcccgctgataaaaacaacccggttctttggcgaataaaagcagccaaagccgcactgtcggttgtcacttgacgcacatccaaccataatagataagtcgcttgggcttccaccaacttgacttgcggcaactcagcagtcaagtaagtctgaacttgacgttgattggcagctagtttggttcgcaatgcggctacccagtcatggccttcagtataggccgcaatgctggctggaatcgcaaacgaattgggctcagccaattcatcattgttgatgccccggctcactaatgcgcggacgtgtgcatcgggaataatcaacgttgccgcgtgtaaggctgccacgttgaaagtcttgcttggcgagatacagctgatactgttatgtgctactggcgcagtcaatgatgaaaatggggtgtacgtgtgaccgttaagggtcaagtcacaatgaatctcatcggcaacgactagcacatggtatttcaagcacagctcgccaaggcgttgcaacgtcgcacgcgaccagacgatgccgattggattctgcggattgcataaaatcatcatcgtggtcaacggatcagctagtttcgtcgtcaaatcgtcccaatcaatcgcgtacgacgcgtcacgtgccactaagtcactactcaaggtatgccggccattgttttcaattgaatgatagaagatattataaaccggagcctgaactaacacgttatcgccagccgctgtcattttacgaacaattgatgaaatcgccggaacgacgccggtgcagaacatcaaccactcaatttgcggacggaagttgtgttccgttgcccaccagtctgccacggcttcatagtaagccatggggacttcttcgtaaccgaagacgccaaactgggcgcgttttatcaacgcttgcttgataactggtgccgtttcaaagtccatgtcagcgacccacatcggcaactcatcatccgcgacgtcccacttaacggcatttgtgtgccgccgattaagcacggtctcaaaatcaaacggcatggggtgcacggctttcatggtcaacactaatcagggtctgatgaggatctacttcaggatcatccatgatgatttcaccaatggcttgcgcatgaatccggccactaagcggatttttaacgctatcaatcgttgaaaccacgtcagcgtcaatgttacgacaatattcaaaagctaagtccgtattgagtaacgtacagttttccaacttaacattatccatgtaacacaggccctgatcgctctcaatcgtacagttgacgaaccgaatattcttcgaattccagcccaggtattcaccaatgatttgtgaatcataaacggtaacattttcacaattccatagcgcatccttggtcatcagcgttgcatgatgaatttcaacgttcttagcaccgtcaaaggcgtaattaccgacgaggttgaagccatcaatgcgaatattctggctattcattccaaaataatcaccagctgcttgaacatcattcaacgtaatatcttggcagttccataacgtttcttccgcatctgaaaagtgaacgtgcgctaacttaacttggctggcccgccgaaatagcttaggtgcctgtagcgtactattcgtaatcgtaatatccttggtgtaccagatgccagagcgagacattgtctcaaacaaaccttgatccacagtcacatgttgactgtaccacaagggatatttccacttaaagattggctgtttcaacatgacattgcgactttccttcagtggtgattcaccatcagcaaacgttgtattgtcgatttcaaggtcgtgagctttaaagagtgcccgctcgcccgttaaatactgttgtgtgattgttttcaatttaatctcaataactcctttatactgaaacgtggacctttagtcgcacgataggatcagtgtattacttcaactgcacgttaagtcaactaacttgttcgcttactgtccggaatactgattccaattattagttcgtgaccggttaagtgccatcacgccctccaagtcatggggttggtaaggggtttccaagtactgtatttccgaagcagttaacgccaacaccgctgcctcagccactgcatctaaatgatgcggcttagttgccccaataatcggcgccgttactcgttgttgtagccaggccaaattaatggccgccattgaaacatgatgttggtgggccagttcctcaacgcgatcaacaattggttgatccatctcgctggtagcttggtatttggtatcagcaaacgtatcctgttgtcgccgagtagtctgggtgccaaaaggatgtgccaatcggccactagctaatggactatacggcgtcgttgccaaaccgttctcatgagcataactgaacagttcccgttcatcttcgcgatagaccaaattataatgactctggatcgagacaaattgtggataaccataacgaaccgctagcgcattgatctgcgcaatctgccaggaataggcgttagaaatcccaatgtaacgaaccttaccggcctgaacggcttcattaagcccagccatgatttcagccattggtgttaaccagtcccagatatgataaatatataaatcaacatagtctgtctgtaaattctgtagactctggtcgagggaccgcaagacgtgttcacgcccactgacatgattctcgatttcttgggtggtccgattcgtaaacttagttgccagtaccaattgatctcgctgaaatttctttaggccttgtcccaagacacgttcactcgcacccgcctgatagaccggcgccgtatcaaaaaagttaatccccattgatatcgcgcgatcaagtacctggttcgcctgcgtttgaccaaccgcccatgagcgctgattaagtgccgttccagtccccgcaccaaagcccatacacccaagtgcgatcgacgagacttttaaatcggatgttcctaattgtcgatattgcattgcatcacaactcccttcgttaactcattaccctctttattaaaacgcgatccgttggcagagtaaaatacctagttcaaataatcaattataaccattccgtatagttatccgtcatccagtcgttttaggaattaatgaccgttattagtcaccaatcattattttcaatgtgcctggcgacatccaagcgtggcaccgtactccaggtgttgggccaaaaatgaacagcacgtttgcaaccataccaggccacatcctgcagtaagtgtcaccgaccgattttaaggacgaaccactgataaaccggtttttggggcaccaccacaactcaccgcgatcaactccgccaactcaatttttcaacacaaaaccgaccattctagaagttacaccttttccagaacggtcggtcatgacaactgattgaatcgccgtaagcatcgctaccgacacgacgacaatgtttatttcagttttaccttaatttttaactttttaggcgcttgatgacgcgctaagattaattgccagcccactttaaccagcgtactaataacagtcatcacgaccattaacgataattttcgacgcattcggcatcacctcaattaatttaaatcgagcataccacactttaatcgacgtgagcggaattttgcaactgaatcatatcatagtagtaaccatgctgttgcaatagctcgtcgttggacccgcgttcaacgatttgcccctgatttaagaccaggatcaaatcagcattttgaatcgtggacaagcggtgggcaatcgcaatcgtcgtgcggttctcctgaatccgatccaaaccagtctgaatcatctcttcggtctcagtatcgacgttcgccgtggcttcgtccaagattaaaatcttagggtcagtcacaatcgtccgcgcaaatgaaatcaattgccgctgtcctgaagaataactggccccgcgctcaatgacacgtgactgataattctcaggtaaatcgttgatgaagtcatcggcctttacaaaccgtgccgctgcttgaacttgttcatctgaaatctgatcgttaaacattcggatgttggaattaatatcaccataaaacataaacggttcttgcaagaccaaccccatcttctgtcgcaattcctcagccggatactcacgaatgtcgcgatcatcaattaagacttctcctgactgaaactcataaaaccgcatcaaaacattaatcgtcgacgtttttccactccccgtctgaccaactagtgccaccgtttggcctggttcagccacgaatgaaacgtcttttaagaccggatgctggccgtcataggcaaaggtgacgtgccgaaattcaatcttaccgcgcgtaatcttagccgtaggatcggcgtgttgggccggggcaatcgttggatcatccatgacccgtaaaacccgtgatccggcgacgacgccatcctgaaagtctgacaaattatccatcatcgacgtcatcggattatagaagttattcaggtacgtgatgaacgcgtaaacaaccccggcagccacataaccattgagtccacgaaccccgaagattcccagaaccatgaccgtccctaacgcataaaacaagtcgatcagtggacttaataataatgagttcgtccggatcatcgcttggcgagtcttaaaataggcatcattggtatgatcaaattcaccattgatgcggtgttcttgtcgaaattgctgaataacactaattccagtaattgcttcactcaacttggtattcaactcactgagccgttcccgcattcgccggtaaatccgtgagctataccgttgataataccaaatcgttacagccaaaaaaggcatgaaaaccaataaccacaaggcaatctgcgcatcggtgagatacatcgcgacaaacgacgaaatcaccgcaaaaaaggcggtaaatagtgtattaaacaacgcccaaaaattggaaaacgacatcgtatcgttagtcaggcgtgacaaaattgagccaccagggacttgatcaaagtaacgcatgcccatccgatgcaacttggcgaacatttgtcggcggacattttcaagcatatattctgcccccatcgtactactgaagttctgtacgaactgcatcaacgcgcgcacaaccatgccgaagaaatacaggcccgcaaagtaccacatgaccggtaccgtggcgtgtcctgttttgagataatgatcaataaaggtctgtaatacacgcggtagatagatattaaccacactaatcagaccggaaaaaacgatggccgcaataaaaaaccatttgaacggtttcgcatacggcaatagtcgccgaataaccgtgagttgttccttaacaggcatggaacgtgcccataccgattgacgtgctgccattattgcaccgctccttccactttggtctccaattgttggcgcgtaaacatcttctgataccacccgtgttgcgtcattaattgcgcgtgggtccctcgttcaacaacgtgaccggcatccaacacaatgatttcatcagcgttcatcaccgaacttaaccggtgggccgcgataatcgtcgttttgtctgctcgttctgcctttagattagctaaaatttctgcctcagtttcggcatcaaccgcggataacgcatcatctaagatcagcaattcaggattgatgagtaaggcccgcgcaatggctagtcgttggcgttgccctccagatagcgagataccttcctcaccaacttgggtatcgtaaccagcgggcatgctggcaatctgaccactcaaatcactcttggcggcgaccgcttccacaacggcttgactcacagtcggatcggcaaaacgaatattttcacgaatcgtattcgagaacagaaaactatcttggggcacataaccaagggctggtaagtaactatcaagcgcatactgcttaatatcgtgaccaccataagtaatgtggccctcgtactgatcaaattcacgcaaaatcagtttcataatcgttgatttaccagcaccaacccgcccgacaattccgagcgtctgtcccgccttcaaagtaaagtccacgttactcagactggttcctgcatcgttgggataattgaactgcttgatttgatactgaatatcaccatgcgggcgctgttcaatgccccgtttggcatcaataatggcactttgctgattcaataattccatgacccgatcatacgaggcgtttccccgttccatcgtgttgaataacatcccgaccgcaaacatcggccagaccatcattcccaaataagtgacgaacgagaccaagttaccgattgtgatgacaccgtgggtcacgtacaacccgcccaaaataattgtggcgccgtaagataacgcaataatcatggtaatcgcgggatcaaatagcgagtcgagtacgttgacatgccgattgatcttaatcgtctgatcaatctgttgattaaaatcagcaacatcggccttttcctgacctagcgctttgatgactttaatcccactgatactttcctgggccttattattcagtcgcgaaaaggcggcttgggaggcacgaaacgcgacgtgaatttttttacccaaataccgtgacacgactgctaataatgggaaaggcaccaccgcaatcagcgtcagtcgccagtcgattagtgtcatcatcgcaatcagcgttgtcccaccagtaataatggaatccgcaaattggagaatgccaccaccagcgacccgttcaaccgccgtgagatcattggtcgcatgggccatcaagtccccggtacggtattgctgataaaacgtcgcatccatcttcataaaatgccaaaagagtcgttcccgcagcgttcgttcaaggccggctgcaccaccccagatggcattccgccataaataacgcgccaggtactgaccaacggcggccacaccaataataactaaatagaccgtcagcgtgtgcgccgtcaagctgtgctgattaatcccatcaacaacgtccccaataatccggggcggcacaatgccgataatagcagtcaaaactagtccaagcacccccgcgaggtacaacttccattcacgccgaaaataccagcctaatttcaaaaatatactcacagcgcacctccaataatttaattaaaatttaattagacaactttttataataccatacctcgcgcaaaccccttaatgataagttccatcccgaacgcaaagtgattgcaccagattgaaaataagcttaaactggggacgttagtggggcggtcattacgatcgtccctttcaatcgtaaaaattcagattactgattttttaccaccgactattgggcttggtgagctgtccaaaatacgccaattatttttataaggagtgttgattgtgtcccaaccaagtaccgtcactttaaaaaccaaactggcaatcttatccgttggtttactctcatttgtcgggattctcgtggaaacatcgatgaatgtgacgttccccacgctgattaaaacaatgggggtttcactagataccgtccagtggctgacgaccggttacctattactgacaaccattgtcatgagtaccacggcctatgttctaaagcggtttaaccccaagcccttattcttatttgccgccctcgtgtgtctgcttgggggcattctttgttggttagcgccgaatttccccgtattattaactggccgccttttacaggccgtagccactgggatttcgattccactgatgttccagttgattttcacttacgtccctcgcaatcaactaggaacttatactggtttagctagtgtcatcgtgtctctagccccggctctcggaccaacttatggcgggattttaactagcgtctggtcatggcgggtaattttcgttggtatcgtaccgttattggcattactggcaatcttaggggcgttcaacatttcggggaaggccttaggtgttggcgataaaaaattcgactatctgggtgcaatccttttagccatcaccttcactagtctgttgttcacgtttaacaacgcgggaactcacggctggctgtcgccgaacttcggcctctggtgtctgtggagcatcgtgatgattggtgcaatggtgacgtacgccatcaaggggcgtcgccaactgatcgattattcaattctcaaattgccaatcttgcgacttcggctatttaattactttggtttacaattcattaatatcgggttgtcgttcgtcctgccacttttcgcccaaaccgttcttggggcttcggccatgacggcggggctcatgatgttgcccggcgcaatcgtcggcgccatcactgggccaatcgccggtcgaatttacgataaacaaggcccaacgaccttattaacatttagtgccatcatggcgagcgccgccttactattattctggctgacaaccgattacttcacagtcatcatcatggctgtcatctacgcgctactacgtgtcggctttaataccggttttggaaccgcgatttcggatggtagcacccgcgtccctctgcctcaaaaatccgatcaaaactcgatgttcagtatgatgcaacagtacgccggttcaatcgggaccagtattatgtccgctgtaattgccggctatgaaattcatcacccgactgtgactggaacaattatggggagcaaattggatttcttgctattattcgtgttggcaatcgccattttggttagtgttttgcatgttaaacgacttgaagcggggcaaaactaggattgactgatagcatcgttagtcttgcaagtggattgattgctgtatttttggaaattaattctttaatactttgaaactatttacactttgtaggatgtaataccctttgtccttcttaatcacctgacaattaccaaaggtcgtttgcatcaatttcttcgcagatggtgcgccctgctttttctgtaaaacgacggtgagtgttccaccaacgactagccgtgaaacggcccccgttaacatcgcatccaccactgccttacctgcgcgcaccggtgggttggtgacaatcgccgcgtaattagtcgcggtgacttgttgatagacatcagacgtaaaaatattagtattcgtaatttgattcaaagcaacatttttacgcgctaagcttagcgctaactcgttcacatcgaccatatcaaccgttcgttcgggtgattgatacgcgagcgccatcccaatgggaccatatccggttcccaaatctagcattgggcccgctggcaaatcagttggatcaaacgctgcaagtagtgttcgtgagccgtaatccacggtacgcttggagaagacaccgttgtccgtcgtaaatttaaacgagtgattaaaaatttcaaaattccattgcttttcatcatgcacaatatccggattgtgtgtataataatagttggtcatatttattttcctctaaatttctggtctatatctatgataactgattcagcgagtgaaccacaaataatttaaaaaactttttagtcggttaaaagctgacactaacacaacatctagggcttgtgatttttaccacaccctagatattgtgttttttgattgtttttttcaccacatgttgtatactaaatttatcagaaaaacgagttaggatgatgaaaaatgaaaaaagttactgtatttactaaaaacaactgcatgcaatgcaagatgactaagaagttcctcacggcgcacaatattgcctttgaagagaagaacatcaatacgaatcctgaatacgtcgattacctgaagagtcaaggtttccatgctgttccggtcgttgaaatcaatggcgaagacagcattgccggcttccgtcctgatgctttaaaacaattagctgtttagtttgttcacgcttttttgcatggttacatagctggtttaccctttaaaatatgataaacgacccacaatcatcaacctactgattgtgggtcgtcgattttgccagccacaattatactgatagaaagaggattccttatgaccttaaaagatttaaaagacgtcacgtattacgacttaaataatgagatcaatattcccgttaacaatcagattccgctcaacaaggatcaggaggcacttgccgctttccttgaacaaaatgttgaaccgaacacgatgaaatttgatagtcttaaggcgcgctttgactacctacgtgaacacgactatttggaaacccctgccattgataagtatgattttagctttatcgaaaaactttacgattacttgcggtcgcaagacttccacttcaagacgtttatggcggcttacaaattttatgcccaatacgccttaaagacggatgatggcgactattacttggaaaactttattgaccgtgtggcaatgaacgccctctactttgctgatggtaatgaagacttggcgatggacctggccgacgaaatcgttcaccaacgttatcaaccagccacccccagttttctcaatgctggccgggcccggcgtggtgaattgatttcttgcttcttgattcaatcgaccgatgatatgaactcaatcggccggacgattaactccgcgttacaactttctcggatcggtggcggggtcggtattaacctcagcaacttacggggtgccggtgatccaatcaagcatatcgatggcgctgctagtggggtcgtacccgtcatgaaattattagaagacagtttctcctactctaaccaattaggtcaacgtcaaggtgccggggtcgtttaccttagtgtctttcatccagatattattgcctttctttctgctaagaaggaaaacgccgacgaaaagattcggctcaagacgctttcactcggtgtcaccgtacccgacaagttttacgagttgatcaaggctgacgctgatatgtatctcttcagcccttacggcgttgaacgcgaatacggggtaccgttctcatatgtcgatatcaccaaagaatacgacaatatggtcaagaacccgaacatccgtaaaactaagatcaaggcgcgtgaccttgaaaatgaaatcagcaagttacaacaagaatctggctacccatacgtcgtcaacattgataccgcgaaccgcgaaaatcctatcgacggtaaaatcgtgatgagtaacttgtgctcagaagtgatgcaagtgcaaaccccatcattaattgatgaccaacaacagtatgagaagttgggaactgatattagttgtaaccttggttcgactaacattgttaacttaatgacctctccagactttggacattctgttgaagccatggtgcgcgcgttaacttttgttactgaccactctaacgtcgacgtcgttccttccatccaaaaagggaaccgtcaagcccatactattgggttaggtgccatggggctccatgcctttttcgcgaagaatcagatggaatacggcagtaaagaagccgttgactttaccaatatctacttcttactcttaaactactggaccttaaaagcttctaacgaaattgcgcgtgaacgtcacgaaaccttcgttaactttgaaaaatccaagtatgccgatggttcttactttgacaagtacaccacccaagattggcaaccaaaatatgacaagaccgctgcactgtttgacggtatcttcattccaaccaaagctgattgggaagccctcaaagaatccgttatgcgtgatggtctctatcatcaaaaccggatggctgtcgccccaaatgggtcaatctcgtacatcaacgatacgactgccagcctacacccaatcatcaaccgggtcgaagaacgacaagaaaagaaaattggtaagatttattatcccgctccttacctatctaatgatacaattaactattataagtcagcatacgatactgatatgcgtaaagttatcgatgtctatgcggctgctcaacaacacgttgaccaaggaatgagcttgaccctcttcatgcggtcaactattccagctggcttatacgaatggaaagatggtcgcactgataagatgaccacgcgggacttaaacattttacggaactacgcctaccgcaaagggatcaaatcgatttattatattcggacctttacggacgacgatggcgaagtcggtgttaacgaatgtgaaagctgcgtaatttagtatcttagatctctaggaggataacaaatggcaacagacttggcttactaccaaaaactgctcagtaatggcaactataaggcaattaactgggatcgagtttcagatgcaattgataaaagtacttgggaaaagttaaccgaacaattttggttagacacccggattccagtttccaacgacatggcagactggcgtgaattagatgatgatcaccggtgggtcgtgggacacgttttcggcggtttgacgctgctggatacgttacaatcacaagacggtctgcaagcacttcgccgcaacgtcttaacttcacatgaaacggccgtattgaataacatccagttcatggaatccgttcatgcaaagagttattcaacaatttttgaaacattgaatacgccggacgaaattaatgaaatttttgactggagtgacagtgaagaattcttgcaagcaaaagcccaatggatctacaagctttacgataacatcgacgaagatccattgaagcaaaaagttgcgaacgtctttttggaaactttcctgttctattctggtttctatacgccactgtactacttgggccacaaccaattgccaaacgttgccgaaatcattaaattgattttgcgggacgaaagtgtccatggcacttacattggttataagttccaattaggcttcaaagaccgttctgaaaagcagcaggcagaatttaaagactggatgttcgatttcttatacaaactctatgagaatgaagaaaactacattcatttagtttacgatcaaattggttggtctgatgaagtcttaacttttagtcgttataacgccaacaaagccttgatgaatctcggccaagatgccctcttcccagatactgcggaagacgttaacccggtcgtcatgaacgggatttcaacggggacttctaaccatgacttcttctcacaagttgggaatggttaccgcttgggtcaagttgaagcaatgcaagacaccgactacgatattggtaatccagacgattaatcaacacgttagttcacaaaaatgcggcgcctatccgggccgcatttttgctagaaaattttatcttgggggtagtttagaatggcaattcataatatctgtgttttttgtgggtctaattctggtttagatcccgcatttagtgagaaaacggtggcactcggtcaatacttggccgctaatgattaccaactcgtctatggcggtggcgaccatggtttaatggggaaagtcgccaaagcaactatggatgctggtggccgcgttatcgggatcatcccgcattttctggtcgcaagagaacttgcatttaaggacgtcacgacttttatcgaaacgcgcacgatgaccgaacgcaaggaaaagatgcttcacctcgctgacgcctttatcgttttacctggcgggtttggcacctttgaagaattcttacaaatgttatcttggagtcaaatggatattcaccaaaagccgattgcgctctacaacatcgacggcttctacgacgatctagtcgccatgctacaaaagaccgctgatttagggtttgcccccgaggctaacctcgacctattcattaatgggcatgatcttgatgaaattttcgctggtttccatgatttcaaacatgtgttaccgcctaagtatacgaactaaataatctagcctacgcaaaacagctctagtgcttctgccacaattagttcagccctcatcatattagtcggctgaattctaaagtcatcataaaatgccccatcattgcttctcgcagtgatggggcattttgctatgtcattaacgatacttactttatgacatactattcagttatttcaatcgtttcaacaaccatactggccggtgccgctcagacttgtgcacccgggtattaacgacttgtagcaattgtaaaatggtgaagattagtgaattacgttttcggtacgcaatgtacttcggttcccactcagtcacatacttctctttgtacgaccgtaatccctgaaaaccatataactggtagccatattcgtaaattaaatgagcaattttttcttgaataaaactgtagcgtgaaacccctacaccggataatggtgccattcccatattgaaataagcatagccatcgtcacgcgcctgttcaaataggtgcacaaagaccgtgtccataatgccggatggcgccgatttgcttgaccgcattaagtcaattgaagtcgtctgatgatttccctgcggcataatattcgcaaatgcgacaattcggtggtcaggatcataaacgaccgctacgggtgcctgattgagatactgctcatcaaaaaatccgagcgagaatcctttttccgtctcacctgctaaccaactatccgaaacggctcgtaattcagccataacgtcggcactgaacggtggctgcaagatggcaaactcatagtgatcacgggtaaacttattcattagggcccgctcaccccgtagccgtttaccagccaaactaaagtctgccaatttaacgtgcccttcttcaccagttttgataaagtcaaagcccatttcgtgtaggcgcatcgtcagcatctcactaatttcgtaaaagactagcgagcaaccgtcactatctgcgtcatccaataactgttccaaggcagcttgtaataccgcttgattaccgaatggctctcccataataatcagtttatcagccttctgctggtataagaagatcagttgatcgaccccatcgacttgatagtaatatgctaacttatcattcaaataagccaagtgtgagatttcattgccgccataagtttcaatcacttgtttgacccgagccgcatccatcttttgacgcaatcgggcgttatagccactcgcaaagtagcggtacataataatcaaaatcattgccgctaagactaacccaatcaccccaaataaccagagcttttgtgatgggaagaacagagcttcaggaaccgcatgccgatgatgaatttggggcgcgttatagacccccacaatcgtatacaagataaaggtcaccacatacacgcagctaacccacaacgtttgcccccacgaaaaagccaaccgatcacgataataagcatgccgcgacaaagccactagcgctagaatcacaatcaagaaaatcacaaatttcatcgaaattgcatcataaacgacgagccagcgaatcgtattcaaaattgcaatcagcaggacaatcaccgttggccaaaaagcttttttgacccggccagcagttcccaacgccaccccaatcagtaagaaggccataataatactgctggcctgattaataaagaaaaaggtgtacggataaaactgtaagaagagtttattgttatatgcaaagttagggaccgttgacattaacaacatcagaaaaccagaaaaatagagaaaaaccgtcagtaccatctgagcaacacgttgtaatgcctgcttaggaatacccgctaagcgcacgtttaagcgatggccggtgtcatggatgaataagaccaacccgatggcaaacgggataatatagtagaataaccggtaaaataagagccatgcgactgcgtctggtcgagaaactccgaccgcaccgaggccaaaaatcatgaaaacgtcgaatgacccaataccaccgggtaccattgacacttcaccgacaaccgaagcaatcacgaataacggcacgaccgctgcaaaatcaatgggtaatcccataaagtttccaattaataagaagaacagcacacagccagtccattcaccaaacgacccactcaataaccgaacgacgttgccgagcgtaaggccatcgaagaattccgaatcgttgactcgtgtaaaaataaagatggctggaaaatacagtgcaccaccgacgagccagatccagtaactgccatacatgttcccaatgccaaagccatagactagtacgagtgaaatcatacaatataatgacaatcccgaaactaaaaacaaagcgatcttggaaatggcaaacacgatttgtttcttagtggcttcgcgattataaaagttagcacgcagtgaggcgcccagcacgcccccaaaaccaccgatattcgtaaatgtattggtgatccatccagcttttaagatatagccaagtgaatagtggttgggtaaaaactttgtaatcatgacgtcatacgtcagcattggtgtcactgcgataataccaatcacgaccatgctcaacagatgccaccagctttgcgaagcaagcgcattcgccaactgcgcgccactgacttccttcgcaattttgccgacttccgtaatcacaaataacaggacagagaatacaaataatgctttgatgatccccatgcgtttattgagtgccgtcccgattttctgtaacgttgccttcaaaaaaattcccccattggtgtgtttgttctattatcgcaatcttagcctgtttatacaaccgttataggtcgttaataacccccacaggtctgatttgtcgccgtattaagctatgaacattttaaatacctgttactaaattgttccgaatgggtgttagtagttagcactaattatgattaattatcgaaattaataccagcataaaccaatattaattgatttttagttgccaaacttgctttgccaacctttaccgtttatgtataattaaagtgatacataaacaaggaggaatttcttatgcaccatgcaaaaaaactcgtcgttgcactaacgagtctactcatcttaaccggctgtaccactggtaatcaacaagccgccaaccataccagtgtcaaaaccaagacggttcgggttgagaaacggactgctgctaataaagccgcctgggcaaaagcaagggccgctagtcgggctaacgcggcctcagccaaagctcttagttcaaacacgacccaactcgcaattgcaactagtcaggctaagcgtcaatccgaacaactaaaagcaaaacatgacgacgcaatagcatcatcaaaatcagcgtcacaggctgccgccaaatcagctgctagtgaagcggccgcacaatcacgctcccagtcagaagcccagtccgcttcggccgtcgcagccgctagccaatctaagcaagcggtcaaggccagcagtcaagcagctgctcaaagtcaacaaactcaaactagtaccgcaaccacgagtcggcagaataatttttctggcgataccgataccgcccaaactggacgtatcgtgggtaaccgcaattccaaaatttatcacgttgaaacggggcaaaactaccggatggccggtaaaaatgccgtttactttagtacggaagacgcagcgcgggccgctggtttccgtaagtcatttcgataggaggatcacttcatggcattgatcggcaccatcttattatttgcaaccctgtactggttctggcgcttacatcggcgctaccgtgggcgtcaatggtggcggcatagttggccggccattatcgcattgctcgtcagctttagtattctcggcacatctgatgaatccactcagccaactgtgaaaacaaagaccgttactaagacacacttagtaacggctaataatgacaagcaattgacggcacttcaggctgccaatcgtgcttctgctagcagcttaaagcaggctgtgaaaaaactttcgagtagtcaacaacatattgacaaactcaaggttacgaacaagcaatctggtgcaacttcgacaacagcaccaaccaaggtcaattctgaccataatccaagtaacactacgttggctagtaaaacttacaacggtcaacaaacgatcacgattaatcagaatcagcccgcatttaccgctaaggagctcagtacgagtcagggtgcctggcaacaatatggcaatttagactcacttaaccgggtgacggctgctaatgccctcttaaatcagtcactgatgcccaaagctgaacgtgaggccttgaatgttcgaccaactggttggcataacaaacgcatcagtagcggttggctttacaaccgcagtcatctgattggctatcaattaacggggcagaacaacaatatcaagaacctcatgaccggaacccgttctttgaatgaccctgaaatgacgacctatgaaaaccaagttgcggcctatttgaaagaaagtccgaaaaactacgtccgctatcaagtgacccccattttcaaaggtaacgaactgttagcccgcggtgttcaaatgcgtggtcagtcagttggtagcaatactgttagttttaatgtctatattttcaatatccagcccggtatgaccttgaactatactgatggcactagtcaggtcagtcactaacgatcattgatcatcgtattcagcctatcacgcagcagccacaaaagtgatagtgccctgtcgaccagaagttcaacccaagtgaaattttaaaacaagcccaacagacgtactatgcgacgttctgttgggcttgttttgacttgcttaatccaatacggttacgcctctaacgccaagtcaccgtaatcatacggtggttgatatcaaattgcactaacacttagcctaagtataaattctcagtaatcgttatatgcgtggtcatgcacgtgattcgcaccaacgccacatccagagataaaaaaaaatcaattaaaactttcttcggctgtagtcgtagtatgccaccagaagccagcataatcgacaggaacatgatggctaagccaaagccgccgagttcaactaaatccattaccgtgacattaacatctaagttcgtgtcggtcgtggcactggcattaccagtctgaccgccgccactaggcatattgccgcttggcttgctaccaccagtgttaccactaggggtgccgccaccaggctgaccctgctgactagttgaactcgtcgtagtcgttgcagtcgtcgtttgttgtgaaactaactggtcacctagcttattaccaacaaacttaccaccgaatccggctaagacaactgagacgatcaagaccatcaccatttcagcaaagaattgagcgacaatcttccaacggctctcacctaatgataacaagacaccaatttcatagcggcgttcacgaatcatcaagataatgattaaagctaagataatcgttccagcaatcgcaacgagccagacaatcttatccgcaaatgatttaacgttattcatcgaacttttaaccgtttggtaactgctatcatccgttgataacgaatacttcgacgtattgatcaactgtttaccagacgttttgacgctgctaactttagcggggtctgagattgcaaaagtcacagaatcagctgtgttcttgtacttagaacccttgaccgtgttagcgaacgtgtatgacgtgtaaacactgttgctgacatcggtactaccaggaccttgttgcgtacttgcactagatgacgctttatagatcccaacgatcttcatcgtgtaagtcttcttatcaccggtcgttgcttttaacttaatcgtatcaccgacgctcaggctatcttccttagccaattcactttcgatgacaacgttgttagtgccttcatcactagctgtaataccgcggcccttcgtaattttacttgagctactttcaaaggttgagacgctgctcgtattagtgaccccagtaatcgagatatcaccagtaccactgctacttgagccacccatacctttcatcccaccaccggtactgctacctgatgttgaaatcgtatcaaagcccttcgcattagcggaagttgagacggtcgcattgtaacttgaaacgttgctaagcttggcgattttcttcgcatcactcagtttaacgggtgatgtcgttaacttaggccgactacttttactcgtcgacgtggcgctgcgcatcttcttaaaagccgcctcccggttagcagataaagtgacggtcgccccgacacttttcttggcattactagttgccgtatcggcagcattcctaatcaataacccggccaatacaaacagcatgattgctgacgtgacaagcactaatagaattgaacggcctttttttgccgttagattgagccatgcgcgtttaaaaaaattcacgcttaaaccctccttcagataaaatattggtatgacaattgctttgcactgcttttaacctacacgggaaatctgactaatttgtgaacttgctgagtttatttatgggcctgaagctgaatattttttaatttgctagccaagcccctgaaaagctggttgtgcttgctactactagcattgcaccgtatctggggggtgtttttacatgcgttaatcaacactttcgctgaacgccaaatagtcgcgacaagaattagtaattaattcttatcgcgactattgaacttattgattgaactcgttactcacacaatcgtaaacttactcttccggcacggtacttaagtgccacgtgatcgtaccctgataacttccaggaacagcggcgggcgttgttttgagcaccaaaccttgttgcgatgaccagtgggcggtcacgtcatagtcgatccctggggccgtcttttggcgcgcgatttccacggcatcctttcccaacattgtcagcttggcaccatcctgataatacaagtttcccgctagtgtgcggccctgattagtcacgagaggggtcgcggtcgcctctaagcgccaagcggctttcgagcccgtatcatcattgacaactacttcaagtccctcgggccgactgacttgagccgttcccgtcagcttgattggtgcaaacacactttcagtactgacttttttcagctgtaactccccaccaatgaccgtgaccgttactgtcactggttctgagtaggcgttatctttgctatgagcccgtaacgtaatctgattttcaccgatttgtagttcttcggcatccacttcaaattcgacataaccaaccggatcgtccatgctcaactgatagtcttctcccgcttcaccattgacccggtactcgatacgcatgccatcattgtcaaagtctaacccatcatttagcttaatttggcccttaatgatgacgggctcgcctttcttcacttgtgtcaacggttcaatcgtcaggttaacggtcttattggtcgtaatggtgaagtgcggtgtggccgttgcggtcttcatctcgtgaccctcaaagtaactcatgtcatcatcaacaaaagtatcccgatcgaccttggcagcctcaccaatcagcgtaatataagcgtgtggatttttcattgatagtgtccgctgcaaatcgtgttgtaagcgggccgccgacgattcgttatcgtccgctggtaaattgatctcttcctcggtaccatccgcatagcggatcttcgcgtgactaaagtgaacttgttcgggtaatggtaggctggccttaacctgttgccattcattgtcaccattgagatagctcagaacgtactcatattccaactcatccccaccatgaacccagtctccttcatggacagttcgctcttgagtcagattggttacgtttaaatctgactcgatttcaatcggttgtggcaaccggtcaaagacgactagtgttctggcattagcggttgtcgccgtactagttaatccccaagtaacatttcggatatcctttccaaaaactgtcgtatcaattgtggtcattcgtgttggtccctgatccagggtatagctcataatttgtttactggcgacccacttcaatacaagatggtgccagttaccgtccgcgagtggtaatttatcagcgatactcccatggttctgttcaaaacgataagaggacgttaaaccaccccgttgcgtataagtatccggacttgcagggtaactcgtggccatatgcatttttttaggcttttcatcgaaagaattcccccggggatataatccccaaaaaccaccgtcattcactttggtatccagttccaacgcccaacttttttgaatcgccgtcttagcaatcgtggccggcgccgttcgccgtgtataggtatccgtcccataaacacccaagttctcaccaataatgcttttctttccataccgactaatcgcactcattttgcggggatcattctgtaaaacaacggccaatccttcacccacggctttgtccccaaagttcacccacattgagacttggttatcgacccgcatgttaaagcgattaacaggggtcgaccacattgccccaacttgattatcgtcatttgttaattcgataacatgctgcgaatggccattctttgaaacagtctgcattgtggccgaattacggtcaaactttcccggttcaaataagccttccagattcagtccagcgggtgccgtatcaagtacgtcagccttactaactaacggtatcactgcccctaaacagacaaacagtcctaacaagagtccccaaaaccttacttctttcacctaacgtcgctcccatcacttgccttccgcagctattcttacgccgtatcttagcaaattaagcgacatcatgtcaattatttttatagttataataagtatttatttatacataaaatttaagcaatcgcacttataccaaaacatattgattttaataaaaaccagcgcctgacagttgtcatcgcgctggttttaaattgacggctcacttactcaccgcgccaggaattaagcgcgttaggccggtaaattttctggagcaaatgggcagtcgaccacgtgatcattaatgagaccagtcgcttgaagataagaataaatggttgtcggcccgacaaacttaaagccgcggcgtttcatctctttagacacttgttgcgccaagtcgtttgttgccggaacctcatcgattgacgtccacgcctggcgtataggctggttatcaacaaacgcccataaccaagtggcgaagtcttccccggccggccaatctcggatcacacgagcattgttgatcgttgccattaatttctggcgatgccgaataattcgggcgtcggttagtagtcgctcaacatcggcggtcgtcatagcggccacctggtcaacatcgtaatccgcaaagtcttcattaaaagccgcccgcttattcaggacggtctgccagctcaatcctgcttgataagtctccaagcacaatagttcaaaaagtcgctgctgattatgttgcggccgcccccactcgttgtcatgatacgcttgcattgctggtgatgaatccgcccatgcacatcgttgcattaaaaacatctccttactgccgctttccaccccggctatctcatacgcccagattaaaacgaacactggttttaaaatttaactgtcgctctaaaaaaagcgccgtccaacttgaatcgttagacggcgccagttggttacacttattatcgcataaccgacttattttattgacgatttcgtttcgtctgcttttcagcagtggtttcgtcttccatacgatcggtcaacggataagttaaccgaatcaaacttggaataatcgttgggatggcgaataccaggataatcaacccgataatcacaaccatcgccacttggatcaacgtcaagacaccggatggcatcaaggcggcgaacgtcccactcaagatcaaggcagcggataagaccacggccccaatgacggcggaagctctgacaattcgagtacttggtgttgcagccgaattatcaaattcacgatacttcatcatcaagaagatactgtagtcgaccccaagggcaatcaacatgatgaacccgaagaacggtgtgttccaagttaacatgctttgacccaagaaccagttgctcaagatccgtgtaatactcaaggacataatgtaagccaataacaaagtccctaagatgtagaacggttgtaagacagaacgcgtgataaccatcaaggcaatcaagattccgactaacataattgcagcggtccgaacgaagtcactagaagcaattgcttgggtatcgttcgtttcagacgtttgaccaccaatcgcaatggtggcaccatctaacgcagttcccttcaagctgttcgttgcttgcttttgaattgccgttactttatccatcgctgacttcgaacttggattttcattcaagacgattgttaacttcgttgcgtggttgttaccagacatgtaagccttcaaagcagacttgtaagtcttacccttcaaagtgctctttggcacgtaatacgtcttcgcagccgcggaatcctttaagccagtcaagtagctgttagctgagccaacacctttgttgatcgtcttagtcccgtcgctggcagtcttcaaaccatcttggagcgtctgcatctgacctactaagctttggatactggtgtacatttgttcattaccagaggccacttgcgaggcaccactgttaagcttacttacaccacttaccaaggttggtacttgcgagttcaaacttgcagtcccactggctaattgtgaagcaccactatttaacgttgaagagttggcagctaattggttagtcccagaatcaagcgcactgatggcactcgttagcgttggaatttgcccttgtaagcttgtcaaaccagttgacacttgtgatgcaccgctattgactttagttgcaccagtcgcagctgttgagacgccattggtatacgtatttagttgtgatgctagggaacttgccccactttgaagttggttcaagccagtagtaatttgttgagatccatctaccaatccattggtaccgtttaaaccagattgaatctgttgcatcccactaatcgcagattgcagctttgaaataacttccaaagaaccattattggcctccgttgattttttagctaattgttgcaagttagatagttgcttcaattcactactcaatgtcgagagtgtactcaactccttggttaaggtgtcacctgtcttactcattgctactaaatcatcttgcagctgctgtgcacttgtctgagttgaggtaatacttgatgacattgaggaacttgcgctattaaccttttgagtaatttgttttccgacggcagttaacgcagcagttaatgcagcagtctgttgagtagttaatgcagttccaccgttcttattaacagcatttaccaccgtctgaatatcatcgttacttaaactaacatcttcagaacttgaggccactttttccaaagcagttagcgcctcttttaaattagctgcatcggtttgaacagccttactgttgtccgccagagtcgaagcagttgttgtcattccactaatatctggtagcgaagtcgagctagtagacagcaacggtttcattgcctcatttaattgctctaaacctttttgtaagtcatttaatttttgtgtattagcagtacttgtcgcatctgagacactagagttaacactggtctgcattttttgaagaccggctgttaacgcagatgcaccagtttgcagttgtgaaactccagaagttaaagttccagttccactagagatctttgttttatacccattcagggtatctaacccagaactcaaagtattcgtcccactaaacagactattggcacctgtagacaactgattaacgccactagccaacgttccagtcttactgttcaactggttcaaacctttattgaccgtgtagacaccattagtataagtaactaatccactcgctaacgagctcgaaccacttgccaactgactagctccacttgaaagggttccagtcttaccatttaaagtattgagccctgatgaaacttcatccgccccatccgccaacttcttggccgacttcgcactatccgacatattggcactcttcaatttactattggcgctatctaacccactaccaatcttagttagccctttgctagcagacttcatcccactagtgacggtgcctaattggttgccaacgtataattgatcgatttgtgagccaccgggttgggtgacagacgccacggttttaacacccttaactttttgtaattgtttcgttaagctgtcgataacctttaagtctttttcattatttaaagcatgatccgtcttgatatataacgttgacggttcagccgtccccttggagaagtgatcctgaacaacttggaagcctttcttcgcaggaatcgtgtcatttaattcggctaacgtatcgtagtttaattcattgttgtacgttaggataaacggtaatgagacacctaaaacaacgactaaggcaatgattgggtaacgaactgatgacgctgcaatgccgtgccacatcttgctcgtactaccgccagcaaacttcttcgttggccagaataaccgtggtcctaataatgccatgaagaatggattcaacgttaacaagacgagcaataggatggcgaccgcaatggcaaccccaaccgctgacttgtaaatcgagaagttcgctaacccgagggcactaaacccaatcaatagtgacgatccactgtataggatcgttcgtccggcaatctttaacgcgcgcccagtcgcggcgaccggactatcgccatgactgagttcttctttgaattgatcgaacagtagaatattgtagtcggtcccaatcccgaacaagaccacgaccataaagacttgggtaaagttcgacaatggaaagttaaatttattaacgaggttcatcacaacgctcagcgagataatgaacgacaccccaactgacaacagtgacactaacggcgtaatcggcgagcggaagactaacgttaacacgatgaaaatgaaaataacggtaataatttcagtcttctgaatccccgcttccgtttcctgagtgaagtcatcatttaagatgtcactccccgtcacgtacgtcttaaccccagccgttttggcaccggccgtaatattcttggtcatgttcgcgacggtctggttcttaccaaccattaattgtagtaattgggtggatttgtcttttgaaatcaattgctttttggcagcagcattatcactggcagccgtcattgatttcacgtgatattttgatttttgcactttgaagcgttgaatcgtcccatcgattgcttgcttctggtcactcgttaacggtgaatcaccattattgaagaccaccaccacttggcgcgtattattttgattacgcccccaatgattctgaatgacttgtgcgacttgacttttagcactacttggcaacttggtctggcccttatcacgtaccagactgctgatatttggcaggaagatgatggccgctaccatcacaactagccaaacaatcgcttggattgtaaaacgtctacggctccctttcacgttatatcccttccctaattcagattcttaaaacgacatcgtgacatttaatcaacaatgtgtttaaataataacaacatgttaaatgaaaaccggtgtaatttcaaccaacaattttcataaaatcgtcattaaataaacaaacaatagtatattgttcaaataatgaggtgaacttcagtggtaggtactaaaaacaaccgtcgttcgcaaatgaccgaacgcctaattcaagatagtctaatcaacttacttcaacatcagtcgctagatgagattacggtcactgctgtctgcaaggccgcagatatcaaccggggcaccttttacgcccattatgaagacgtcaaagattgcatgcagaagatggaacaagatgccacggaagaactgctagctgttattgataaacatcttaatcccgactctttacaagccattctgacgggaatttttgaggtggttaaaaaacgccacgccgttacttccttcatcttaacaaccgaccaggattttctgatgagctttatcgcaacaactaagcgtgagatcttagcacataaccaagctgagatcactggtattggcaatcgcgaaaaagagtacatgtttgagtattatctcaatggtatcgttggtgttgtccgttattggttaaaaacaggactacatgaatcaccggaagaactggccagttttatcaacgactggtggtaccggggaaaaccagtcaaaaatttggctgaacactgaatttaaccccactattcgattgttagtttaattaatctagctattcccattaaattaattattaaatattgaaaacacactctaccatggatccaaaatcattaatcggatagttaaaaaacagcccaaaaccgccagtgttgatcgcaaggaagtcctgctttcagaaatcaaagatctactcgaaaatcagcaaaaatgaaaacagccggcttgctcaaattgctttcaaccccccaattaattgcgattaccggatatttgaactagaattaacttatagatgattttcacaaatggaaatacttgagaagaggttttgttatgagaacgtttgcgataagggctcgtgatggggtcatggaaatcaattattcagagaattccaataagcccccttttaggaagtttatgatcacctacaaccccaaattttcaattgccgataatcttgagaacattaaggctgccctcactgggttgccaattgatgcagcaattattgagaattcattgaactatgaattctctgacacgatcatcggtattaatcatcaaaagatcgatattggcctagcaattgccaacatgatgaatattccggtcgttaacctgcataaggttcaagatgttggtttggaaaaagcagtggcagaaaaacaggaatatttgaagtggcaccttgattattatggtgagtacagcggcaagcgtaactatgggcaagaggccatgctgacaatcggtaacggctactttggcctgcggggtgcgtatgtcgaagcaaacgccaaccaggataattaccctgggatgtacgttgctggtgtctacaatcaactcacaaccaaaattaacggtcgggatgttgtcaacgaagatctagtaaacctccccaatgctcaatacatcagttttggggtggatcatcaacaaccgtttgaaattaaaaaagaagatattcaagatatttatcgaagcctaaatttgcgaaccggtgttttaacaaccaccttgcatattcaattatcaactggccacattttgcaagttcgggctaccaaagttgccaatatgacaaattggcatcgttattccatcaagtatgaattaaaaccaatcaacttttctgggagcattcaactctattcaaaaattgacgggactgttattaatggcaatgttgagcgctatcaggatttcgatcaacaccatatcgacgtcattggcatggctacccacgataaccagatttcgttaaccggtcaaaccaagacgtcccacgttaactttgtgattaattctaagctttctagcaaagatatcgataccaccaagttaatttcagctgaaactgaagataaacaaatccagcaaaaattggatatccaagtagaacctgagaaaccgtatgtatttgaaaaatgtgtcacagtatttaccagccaaactcaggatgccaacttgaaacaacccgcccaaaaggaactgaacgcttcttcgttcaatgacaccctcgccgacagtcaaaagttctggagcaacgtttggcagaattcagatatccaaattgataatgatatgaccagccaaaaactgacgcgggttaacatctaccatatgcttgtgacaagtgccgccttggcttctggtcaattagattcctcagtcggcgctcgtggcttgcacggtgaagcttatcgaggccacatcttctgggatgtcacctttgatctaccgttttatgctattcattacccagcaattgctaaacagtgcttgttatatcgctataatcgaatcggtgaagcgcgcaaatacgccgcctcggaagacaagcaaggggcaatgtatccttggcagtcagggatgtatggggatgaacaatctcaatttgttcacttgaacccggttagtggtgaatgggatccggataacagtcgcttgcaacgtcacgtttcactgtcagttgcctacgatgtcattaattatgttcatctaacaggtgataccgaattcatgaagaactacggattagaaatgttattgtcaatttgcaagttctgggtcagcatggcaagctacgataaaaaagatgatcgttacgatattcatcacgtcatgggaccagatgaattccacgaagaatatccaaactctgatgatcacggactcactaataatgcttataccaatatcatggtttcttggttatttgataaagtcgcagagctgatgagtcatgaagatcctaagataatcaaatctgccaatgaaaaagcccaaacagacaatagtttacttgatcaaatgagtgatattgcccacaaacttcgtctcgatatcaacgaagaaggcatcattggtcaattttccggttacttcaatctttccaagctcaactttgattcttaccgaaagaaatacggtgatatatcgcgaattgatcgactgttaaagggtgaaggtaagtcacctgattcctatcaagttgccaaacaagccgacactttgatggcttattacgaattaccatttgatgaagttcaaaacgtcattacccggcttggttacaagttgcccgccaactactttaccaccaatttaagattttaccttgatcgaacgactcacggatccaccctttcacgaattgtttattcagttctggatgaaatggatggcaatatggatcaatcctggcaattgttctcaaccgccttgttctccgattactatgatatccaaggtgggaccactgctgaaggtattcaccttggcgtcatgggtgctacgcttgaaattgaaaccaagtgttacggcggggttcggtttgacaccgacgaggtttccatcaacccgcaccttccaaccacttggagtaagctatcatttaagcaaacgtatcaaggcatcacgtacaattttgaaatcggtcatcataaaatcaatgtgactgccgattcgagcagtcacatcaaggttggtgacaagggttattcattatccaagaacaagccaactgttattacttacaaataagattaggagtgaaatacaatggcaaagttttcagatattaaaggttttgtcttcgatctcgacggtgtaattacggatacttcggttttccacagccaagcttggcatcaagttgctgacaaggtgggtgccccatggtccaaagaacttgaagacggattaaagggaatcagccggatggattctcttgaaatgattttaaaagcaggtaatctacaagaccactatactgacgatcagaaggttgatcttgcaacggaaaaaaatacaaactacttgaagttggttgacaaaatgactccagctaatattcttccggggattaaagaattcctggatgaaattaaagatggtggttatctgttatcattagcttctgcatcaaaaaatgctcctactgttttgaagaagctacaattgactgattattttccaaagattgtggatccaaaaactttgagcaaaggcaaaccagatccagaaatttacctcaaaggtgccgaactgatcaatttgaaaccagaacaatgcattggagtcgaagatgctgccgctggagttgaatcaattaacgccgctggggaaacctccattggaattggtgacaagacaattttgaaggatgcagatgtgagctttactgataccagtgaaatgaccttggctaacattaaaaaacagatggactaattcaatccatttggaaaactggacaattgatgctttaatcccatcatttaagggcttcatcccaaaatccaaaacgaggatttcagggtgaatccttaaatgattgcatgtcgtaagttatttgattaacccgtaatgcttcagcccattcacaattccgccattcacatttgaagtagtgacgaatgatgctttggctttcacatctgggtgaccattacccattgcgactgggtaatccacttcagcaaacatttgcaaatcattcagctgatctccgaaagcataggacggaatgtcctctaattgcgctttcttcaagagtgcttgaatgccggtttgcttcgataccccccacttcatcgtatctaaacagcgaggattatttctaaccaatgacaattcacccttgaattcatcctgatacagtttatctttatcataattaaaaacgttcaagaaattgacttcatgagtcttgtaaaagtccggctcaacgtgcggcgtcaatcttaacagccgatagttaactttagttaagtcattttcagcttttaaggcaaattcttcattgttatagaatgaaatcacatcgccctgctttttggcaaatgctaaaatctcttcaatcacctcatcactaatttgctcagcctttagctttttcccttgatattgaacgtaactaccgttcgcactgactaatgaattgataccggtagcgtcaatcacatattgaatttcaaaaatatttcggccagttgaaattacagggagaatattgttctctcgtaactgattaattgctgcaatgttgtcatcagaaacattcttttgattatcaaatagtgtgccatctagatcaaaaaaaacaaccgctttatacattgaatttcctccatttaactcgatatctacattgtactacttaatctacccttttattttaatgtagcactgcttacatattctcccgcaatacggtatacctgcgctgttgttcctcggtcatatccttgtaatactggtcaataagaagctggataatctcgtagtcgaagctaacatgttcaattgtcttcaggactttcatatccttgtaagtctctgcggataccttaagggattttttctgattttttggcatagaggaagatttattctcttttttcgtagcattatctgttgcatggtactcttctgatggctttaccgctccggtaacccttcgttgaagaatattaggctttttacttggcatcttacttggcctccttatcatctataaataagccaatccggcttaataactcatcggtaacttgctggtacttgtctaacactcgcttatcgaagcggtccttatcggtaattccattaattgggaatcgtttaatccgggccatttgagtaacaatatttgtgaatacattttcttctccaaactcatccttagcagattgtatgattgtctgatcgacaccgttacgggcatcgtgaagcattggcaagataccaattacctctatatctagctgatactcttgctgaagtttagaaagggtattcacatactcttctgcaccggatagactatcatcgtgtgtttgcaagctgataagtgcaaagtctgagaagataacagcattacgggtaatctcaatactaaatggtggcacatccaacagaattacatcatatttcttcttcaatggattaaacaagggttccaacagatgtgtttcttcgtactcattattcgtattctgatataaatatttcgtgaaatcttggaaatcaatatatgaaggaattaggtcaaggttatccattatcttaactggtaagtctgttagatctttctcctgtacgcctaccatcagagtttttttaattgagtacacggtatcttcctgctgacttttcgttaacattagtgttttagtggcgttggcttgtgggtctaagtctgcaaccaacgtatgtattcccattttagctaaggtataagcgatgagatacgtgttagttgtttttcccacgccacccttttgattaccaatcacaatggttaatgcctcatcacgagactgtatagcctttactacgtctggaatatccataacaacgacctccaattgatttttaattagtataccacaacttaatagtgaaagggaaatttccctaaatagttatttagatatatagaattagggatatatagaaattgggataaagggataaagggatacttatcgactgagaacactgttataatgggaattgaaaatatccctaaatagaaaaagggataaagggataattctatttagggataattctatttagggaaaaatagataaagggaaaaagggaaattaaatataattgttgacagatatcctatgaaagggctataatcattggtattgacagtcctattatatgatgtgtttttaacattatttccaccgtttgctgtactaactgtgaatcatgggggacgctgtcagtagttcaaaagaagtaatacctaaaaaactgcataaaaaaaaacacccaccgactggcatcggtgagcgccacacaaaagtcaactcatttactgactattatatcatggccggtgcgatttttaaagccctaggggacaagctggggtctaaatccaaggggacacgtttgccagtgcgacttcaataagtctggctataccacaacaaggtcatctgtacggctgggtggtgaatggtgagcgcgaccattaacggcgcgggtggtaaaacgaagcttcggcttggtgccactgattagttggtgatcgaacaaacataaatacgtattgccaacgcctactagggcgttttttagtaggttaaaccgaaaacgtaggtttataatgagtggtggtagcaataccgcaattgtacagacaagcgacgggcgttaacgaccgacgaactaaggggaaacttttagtagtagaattgtactctggttcagttattccaaatagctgattccagggaacaattctgcgctcaaaacgtcactccctctaaactgaatggaaaaccgtaaaccgtcaagtcaaattccaaagaaaaaaagaaagttggtggaattgttggaatgtaaagattacattgttccattgaatccagatgtgatcgttaagaagacaatctatcggagttctgcaagaattacaaatcagcagagagatcaagtaaaaagagttttgcataagcaagggtatcaggggagaattagtagtattcgatatactcgggtaaattacaagtattcttttaaagtatccgtgaagtatcaggggagtgttggtaagtttttggttaatacaaagaatgagacagttgaatttaagggaatggtctaggagtaatcccagtgaatttcacaaactcattttccccaattaaggccaatctgcaacctataccacttcttttttgggcaagttcacaaagataaaataacggaatgtggaagtgccagggcgtgatgaggttacttgggataagccgccttatgtaaagtgaaaattggtatactaagaaaggctcccggtttaacactggaggccttttttctaggttacatattttgaggatgaatgtttttatcttcgtagtttttacttgggtgctgtaacatgatgaatactgcttagtttttggtgccgtaccccgcaacagatgcgtcgcttcgttggtattatcttaaatgctaagtaccgagttgagaaggatcataaagatattggcgtcataatcccactggacgacgaagaacttaaatttttaatgactaaagccttgagacgttactttaacgccctaagaagcaatgagaagcacatcaagaacgtggaaaactacctgtgcggcagcatgcaaaacctatttggcgtttggtggaataaacaagcggctagagaatatgcggccaaacaccccgaagaagaaaaatcggccgacaacgataacagtgggttgtactactagtcctaaaaggctaaaaaatcctttctaagcgattttaagacttaataatctaatttaatacttaagttagatttaaatggcttaaacataagaataggggcttttaaatgagtgtcagagctaaccaggctaaccagctcaaaagttcagcctttagatcaacgccaagctcaagtgatttgaggccaaggctttatctattgataaggtactcaaaaggtagtataatggtagtagtaaaagaaaggagatgagacaatcatggcagttaaggaaaagaaacgggtccaagtcaagattgataaagatttggccgatgataccgaagcaattttaagcgaattgggcttaaatccaaccacggccattaatatgttttacaagcggattgttgctaatggtgctttaccttttaatgcgtctttaagcgaagaagaaagagctaatttacgctttttaaaggcgaccgaagggacaccagtcaccgagttcaaagacgctaaagaggtcgctgattggctcaacgatccagatgaggactaatgacttagtcagcctatacgttagttttgtagaaactaacggtggcaagtctcggccagttttaattcgtcgggtatcagaacagaaggtcgaggcttttaaaattactagtcagtatgaaaagaagtcggcttatatcaagcaacaatattatccgattcaagattggcaatccgctgggttgaagaaaccttcctgggtcgatcttggtaatatttatcgctttcccaaagcccgtttaaactttaaagaaatcggtcatttaagcaagctagatcaaaataaaatttcagattttacgcttgacctaaaatcaaaaagaagaggtaagggtcaaaagataattcaacagcgatcaagtaaaaggaagcacaaagaaagtaaagcagagcttacacaaagaattcaaaaacagttaaaagactttgctaaacacaatccagaaattaagccaaaaaacaatcctgaaaataaaaacgattggcctagttattagtttgattgttttttaatttatccggtttatgggcgttaacatagtcagcaaatgtttttaaaagttcttcggtttgttcgaccgataggttattagcttgaaagtacttttctaataaagcccctttttgaattaatcggcgagaacgggctttgcgggcttgccgattttcatagtatttagattgtcgtaatttaaaatcttcccgatcaattttttgttttaaacgcgcttgctgctcgactagtttttcatattgattagacatggaatttccccatcttctatgactaatgatctacggacttttcctttaaaaatttggatactttttggataaggacttgatattgtcattagataaattagcataattcaaattagctgatttaatgatttccttaccaaggatttgttcaattttgtttttttcagcttcaattttttgattaagctgttttaatttatcttcttgtttctctaagttactttgctgcataactatccctccaatcatcttaaaaataatcaccgacactatatcataagggaaacgttaagtcaaagtataaaagttgaaatagcgaagcgaaagttatacactaaattaaagttaaggtaatcagaagaccgagtgaaacgaggtcaatgcgcacttacaccccactaaattattgtggggtgtaagtgcttaaattttgtattagaagtcgccgatggcgacaataaggtcaaaacccatagaatcaaagagcttatgtcattaagtaatgacacggttctaaccctttaattatacagtatcaaaaaagaggccacaactgttaagttgtggcttggctagttctattaattataaaatttgttagtaaacaatcaaaaatcattgtgaagtgaacctaatttattttgtacgaacagcattcagattaattttacaatctaacgatttaaaaaatcattaaaccgtttgataaagaatcgttcaccagaagttctgcaaaatagtattattaatattaccattagaacaatagctaaaataattgcatagattattagttgaataaagttatttatcaaaactacatttttaattttaagataccattcacaagcaagaataattaaaaatgcccccatatacgaccagtactttccataaaattttgaaattcctctatgatatgcacctccaaataaaatcagcgggtcccaccatgagtttaccaaaatattacccacaatagtacctaataatacaccgttaatacctaactttgtatagttgactaaaataaaactcaaaccaaaattaacgatagcttcaacaatagatttatatctataaccccagaaaaggccatacgcattgattaaaaataaagccggtctaaacaacgcaagaacaaaattaattacaattaataatacagttgtatcttcaagaacatatttagatcctagccataatgtaacgaagggttgaaataccccaaaaagaaataggccaataaaaaataccgcaaatgcattaacaaaaacaaattgattaaataaattaatttgtttttgaatattatttttctctgtaacaccaagattcccaaaactagcaataacagcattcaatacctgattgagaactgttgttataccagtaataattagtgaatagtttgaataaaaaccaacagccactaaactaacaaacttagaaattaagatattatcagtacctgtaactactatagagccaattttagaagatatagttccaataacattcctcttaattttatcaactattgatttatcgattttttcattacgatttgtttttaaatacggatattgtttgtatgttaaacgcgttatcgaaatattagacagtaaattactaagaatctgtacaattaaaaaaccaaaataactgttaaataaaatcaagaaaaataactggaatacatacttaattatagagaaatatagttggtttttcgaatccacatatcctcgctgatctgctattaataatgacctattatatgtaaagaaataacttactactgtacttaatagatacaaaacaaaatagattctcaaatgaggtaatccggcagaactctttgttaaaaaaggaacaaaataagataacacaagccctacaacaagaattcctaatccaataatattataaacctgtttataaagattaataattgcagtagtttgctttttatcttgcttggccagcggtgcatataaggcataactaaacgcagcaccaatccctaactctgcaaaagataaaaatgtaattaaattattgaatagtccatttgcacctagaaactcagaaccaagtgtgtgaacaaagacagtctgtacaataaactgtccaatcattttaattaattgtgcagtaaaggctactgaagcattttttgctgaagctttacgtctagatatcatttactacccctcataaatctacatatagtagttgctgaacaattaggcaaagatttgccgcactttaaccggcattaaaataaagaaataaaattgtaaagaattaaatctagataatattctgggaacatatttacgagcatacattacttgattaataggtttccagttcgaaagtagttttgaaaaaaaatcaacataatcataatgttcattcattgttatatttgggtaaatagacttaaaaaggtcggcctgaacacatattttatttatatttgaactttgcattgataaaaattttaagagtctttgtaaaaagctattattttcagtaaccgccccaacaacgttattagaatgttgtcgatataaaactgttacttcgggaaaatacataaccttcccaaaagcacttgcaatgattgctaaccaccaatcgtgcataatcattcttgagtaatcaatttcatttttttttgcttgaacacagttttttagcgaacgattaaaaagacatgtacaccccgtaacattattcttaagtaataattcttcaagctccgtatcttgatatccagataaataaccattaattttctcgccatctttattgaccgtttggtaatctgaatgaattaaaattggaatctcttgattctctccttggatagcattgagtaacttactaatttttgaaggcaaccatatatcatcctggtcactaaacatatagaaatccgcatcctctttaaaacaaaggcttaaaaatgactttttaacgcccaaatgtccctgtaaatccgtaactaactgtattcgattatctaattccaaaaaattgtttatgatttttatcgtgttatccgttgatccatcatcatggatcaaaagaatccaattagtgtaatcctgagatctaattgattgtatctgcttgtttaaaaattgttctccgttaaacgtggacatacaaataattattttcggtgtcatcatccctataaaccccttaattttaaaaaaatcactttatagtcaaactatatttattacttatcttcagaaaagaagtctcgatgctgtttaactgataatgctaacatacagactgttaaaataacccaatcaaattggacattataggaaaatccttgaacaaagatagtgagaattacaataaaatatttatagttgattcgaattcctttaataccaacagataaataccacaaataaaataaaactgtattaataaaaccaagtccaagtacattatttacaaagtcactttcaactgcccatgtacttagttctgcatattgcccaatagttaaagtatacaaatatcctgaacaaccatagccaaacccaaaaattagttttataagtggcgtatgagctaatatttgtggaagtagctgataatatcttaaatgaacagctgaactgttatcggttcctgaaaaagaagctttattaatgaaattagagattacaactgaaaaacgatcgtagaaatcaaatttattcactataactaataaagcaattattaacgacaggcccaataatatactaaacatcttacctacagaaaagttttttcttttacgtttattcttattatttaaaattgaaaaaataacttcaagaacaatacacaaacttacgcctagaatacaagtgctattataagaaaaaagagctactataacgattaaaaaacggtaccataagcgtctattcatgacaaaaccaagtactaacaaaggagctaaatttcctggatgccagtgtaacccagttgctaccatggtgccacccctatacatactttcaatatcaatcatatgcaatgtgttaacaaatattaaagtatttaactctatattaaatatttgaaataacaatatctgcaagatagaccaaaataaattaaaattaatagcccatactagccctcgccgaaaacatgataaataactaactgtatttttacttccactaatcaagaaatatataaaacagatcatggcaatagtgatccagccctttaaggctcttttttcccaatctgaaccaatactattagtataagaaagtatagttgtgaatagtaatatcaatactataataaaaaaaagcctatctatcagaaaaatattttcttttgaaatcactaaggctacgcatgttaccataagcaggataaagaaaatagaatatccaccaaactgaataattgttaaaggcgaaaaaaaagccaatatagtaactaattgctctttaaattgtggatgtgccatactttgttctagatagtccattttttctccttactatgctttgtaataactctcagacaaacaatactcgtaagattctcatagaattaagatcaattagattattttctaaatagaatttcattctgtgaaatttattttgaagtaacactttcgaaaattgttgtaaaaaagaataatactgactattcttttttacattctcactcaaccttctaacaaagtcgcgctccaattgaacactttgataaatagcgataattttcttccctaataataaactttttagacgatcatagcttgccgcttgtgtcgcaccaacttgattattttcgtgttgccgatacataatagttgcactttgcacgtaaccaatactcccttcagcacaccctagtaacataattccccagtcatgcatcgctaaattaaggagctggacattctgtatagctaatttgagcattctcttatttatcatcattgtacaacctgcagcaatatttttttgaagtaaattttttaattctattttattcggatctcgatgctcataagaaaagtatgaatcagcaattgtatttaagtttttatctacaacttttaaatctgtaaaaattactgttggtacttgtgtcttagaatgctcgatatttttcattttatctaatgtaacttttattttagtgggaagccaaacatcatcctgatcacaaaacatgatataatctgtagtcggataattcaataatgaaataaaattttcttttgctcctccagttgatggatagtccaatattttaaaatgttcgatatatcgttctgagaactgatgtaaaatactaacagttccatctgacgagccatcatcatgaatataacaaatccaatctttatacgtctgttgaattaatgatttaagtaactcagacaagtatttttcaccattatatgtggataacaatattgtaaccttactcattgcttaccctactttccttggtcttgcaagattagatttctaaaaatgttaagtgactctaaaaccctcttatactttttattcattttttctgcataaccaccttcaaccgcattagttgcaatatcctcatggtgataaatgaatacctctggagaatagacctgcttcatgccatctcttttacactcatagtcaagtatctgtgcttcacaataaaatttagtcttcggaaatagtgcatattctctactttggataaatagcttagaaaaaatataacaagaaccatgaagagtaatgttagttaattcctgagcttgctttttatttcccttaaatcgcaacttaagcttataatagttactttcaataaagctgctctgtcttaaaatacttttaatttttaatctaagctgttgtttttgcattttatgaatagaaagcatttcttcatctatatcagcaatagttataatagttgatttttcaggattttgatgttttaatgctgacgttgaataaatgtctggtcccaaaacataaaaattggttctattaaatatcgaaaataatttttcgcaaaaatcactttgaactatctccatatcattattcattgcaataataaaatccggattatattcttttttagcaaattgataaccaaaatttatcccactcgcatatccaccatttacgtggtttttcaacaccgtaactaacaaattatcatgataataattagaaagttcagtataagaattattgggagaatcattatcaactatcacaatattaaattcacctttaacgttattcagtattgagtctacgcaatgaattgtttcttttgcaactaggtaatgtaacactacaaagctgatcacttaaaattcctcctcgtaaattcaatgatactttccaccaaagtatcatttttttctgtcatatcaatgtttatgagtaatttccggtcaacttttgcacgtataagttgtaatctatcttgatacatttttaaatatgctttctgttcggctattgatagattatcaatagccgaatcatgcctgtctcttaaactcattcgcttaattgcttcattaatacttaagttgcagcatataaaaaccttttttaaatctaactctcttatcatttttaaaagtgtaaaaataattctcaaatcgccttcacgagtcaacgaaaatgcagttattgcctgcagagcaccttcatcagaaacaataattgtgtcattttttttatggtacgcgtcataaatatatacacaatacaacaacgctatataagattcgtaattagaactaaggggggtacctctagatttgctcaagaaatatttcatacagtttaaaaagaatataaaatttcgaggatataatggtaatataaatctatgaatcttaatcatatatttatatggtgctttctgattagcacctctaaatttttcaactccaacaaactctatatttgaatttgttggacatagctcagcaaataatttttttataagtgtagttttaccagagcctgcaataccattactttcatagatcataaaactatctcctttaaaaacaattaataacctacatatatttttttaatttctttgtaatggagacacatacttttttgtggtgtaatcataaactgtttcaaatcagttaattgaccagctatatcttctattctatcaaacctaaactgtggatctattaaatccttagcacccacattttgactaaccaatacatattttccatagctaagagcctcaattgttataaacccaaaagtctccttccagagacttggtacaataacaagatctatattttgataaatattatccaactcattgttattaaatcgaccatgattgataatattatccggtaaatctaccgctacatcgctaccataaacgttaaattcaaaattcttatcctgtaagagtgtaggcaactttagaaattcgaaaaaacctttgtaagtcttatatggaccaatatacgcaattttagttaccttttcgggaattctaaaatcattctttttaacgctagagttagtgatagaaatacaggcatagttatcgcctatttgaatattattctggtaaatactcaaagcaagggtactattgaaatgaaaaaaactaatcattgaaaaaatagatttataatactgttgcaatagttcaaaagagtttttattaattgtttcatttatattctcatttacatttttttgagtcttatctaaaccagttaatttctgtggtttaattttatgggctatcttcctaataaaaggatatgatgaagtttgaaatagccgtaacttccaagtgggcatagccgtttgaccgatttccatccattgcttggtggtattagtattatcataattacgaccctggtaataaaaattgggttctggcgctaatccaaaatagtcatgactggtaaacactatcctgattccgagtgattgcgcacattcaaagaactctttatgaatccccattaatgtgtgaacatgaataacatcaggctgtaatttctcaagaaagtttaaataaagcttagcatcaaccgatcgcataaaatcgttaggattctttattccaccaaaaagtggtaacggtaatgaattaactagcgcataaggggtaaaatttattttactattttttctatcagccttaatataagccctatttcttaatacattaatatggcctggataaagataataaacttcatcaccttgcttaacttgttcattcatcaagtccatcgtataccgaatcaaaccaccactacgttctggggggaaacctaaagaataatgcagaattttcaactaatttgcctccaaaaactctttctcatactcactaacaataaacgaccaactataaacagctgcgattcgctgttttgacgcctgatcaaactgttcgattttatctgccgataaagtatccgcctgttcgatcaatttagccaaggcaccagactgcttgctccagtaaaacgcgctgtcctcaccaacttcacgattaaagccaacatcgaacaacagattcaacttagtactagctaaggcttcaagtagcgatgggttagttccccctaccgaatggccgtgtagataaccatatgccagttcacgaatcttgcttaacaagtcctgatcgtaaaccgtaccaacgaacttgatgcgctgatcctgttcaaagtgggtcttagcttttaacgcatcgtagaactgattatgttcgacattagtaatgatcaccaagtccttttgtgattttgaagtcataaattcccgaatcatggtttcataattattttctgggacaaagcgaccaacaatcaaataatactcgttagcgcgaatattgaatttatggaaccaatcagtaattttagcatcatcgtcggctaaagttgaccgctgtacatcagcgccatacgcaataaaagttgttttcggttgatatttcgcgtaggtcgtttgaatatatttttcaatattcttactgtcacagatcaatagatcggcatgtttcaccatcaaaccttcagaatacttccaatattgtcttactgacttactccatttagcccgcatccattcatgaccgtcaggattaacgtaaacaacgccaccaattgcgtgcacgcgccgggtaatatcccgcataaagggtccaatccggcaagccaagatataaaaaattggctttttgatccggtgccggcgcgcatagcgaattgcttggtttagcgcggcaacatcataataaattgcctgtgctggaccaatattcggcacgtaaatattaaaacaatcagcgttattatgcacaaaatgcttttgcttggccgccgttttatcggtcactttacaagcaacatgatatttaattgttgtgtcctgctgcccctgagttaaatattccaaaaaggtttcgtaaccaccataattggccggaatcccttttgatcccacgatgaatacatgtttttccactgaatttactcctctatttcaacactcacacaaacgctagtcttaacactaaaatagcgcttaatacgcgctatttggccatatcataatcttaacagtcataaacatgatcttcaagtcaaaccagaagctgctcttttctatgtactgtaaatccaattcagtagattgcaaatttaatccgaatttttggacaaatttgcaatctaccactttatcattttggccaaacgatgtgcgaacaaaacaggtgttattaaaattgctagtttctgaggcaaacaaaaagcagtttacgcaatcaccttctgattgcaaaacctgcttttggcttctctcttactgtcaagccacgcaattactggacttggccttttttaaccaacaccggcaaaataatgacccgatccatgtaactcggacgatgcatgaaggtgcctgcttcacgataagctttggcaccactttcaaagatcatcgaaatgtgcttctcagaaggatcaaggctgatgtcttcaaccgagtgtggcacgttaataattttagatcctgactttggtgcagtgaagtctagtttggtccagcttttattgtccggaaccagaatccagattttgcctggtgcgctgccatttgactgactgagcaacgtcagcccacttttggcaacggcaatgccttgaagccgatcccagccattgttagacgaattaatgactttcttttgcttcatcgtgatgggtgctggcagcccatttgcattgagcggtaaggcaaggatcgaacggttctttttgttctgaccatatttaacaaaaaccaattgattgttatatagggtaatcgctgaggtcggtcctgccaaatgaagttcaatctgggttgactttatcggttgttgcgttgctttagccgaataggcatcgatttcgcgctgtgacacataactgataccagcaccttttgtctgcgcatcatcagaccaaagcagccgctgatggtcgatgtcgtaagcgataccaccaacgtgcgatttgctccttaaaattaaggttttattgtacttagcattatgcttgttcacctgaacaatgattgaattcagtttgtgattattatcatacaagctcatatagattgcatctttggactgggtgaacccttgaggcacccagttattgccaaaacccgcttttttggttttagcactgatcgaccaagcaccgcgaagtccaggaatcaccactaatttggcattggtggccgcgcgtttttcaagtggatctgattgcccgatagctttaatttgcttaattgccgcgcttttggactgcaacggccgcggatcagcttcccattttttaacatcacttggctgatcaactaactggctgtactgataatgatcaatcaacgcccagccaccaaagccaagtgcaacgataccgatgactgacaataccgtcacccaaacccatttttccaacatgcatacactccttcatatcagaattgtaatatatttgaattaaccacgcgattatattacccggtaattgccagaaaaaagcaaaaggcgggagtgtcaagaagtttgtgtaaatgggaatccctttcccctgtaaaattaaaccattaatcgaaaagtgaacgctttaatcggaatttacgttatttttacaatctaccttatctgtaacaatttctggtcttatatcaacaattgtgtcgctttttttgtgccttataattaaaggtgttaaaatacgtcataacttaccaccataaagcagtccaattaatttattgacttctaagtaaaataccaggagttctgctatgagttaactatgatcctaggtggtcactaatacattccttaatttaggggctataattataaattagataatacattagaagctggagacaagattgtctagataatgtgtgagataaaatttttggcaggttatcatacataagacaaaatgtttttaaaactgataacgtatttatttcacaacaattacgcatttatttttgagaaaaatataaagcaggaggattacaatgctgaaaacttattctttaacaaaagatacattattagtttcatcagaatcaaatatcaaaaattcttctgttgtttatgtttatggtgacgaaccagaatatatcgaatctttggaacataaatataaccttgaaataggcaatatactaacgtttgatgatcgagttgcatatgacacgatgatagatcagaacgatgaaaaaagtttgctcgtaagttttttgtttcccgaggtacatgaaggtgggcatctagataatctgacgacatctgttgttttcttggtatttaaaaataagttgataatttttacaaaacaaaaattaaaattcattcccgaactcttatccaatatggttttacgtgatgtcaataatttcacggaggaagtacttttaaagatcatgcaaaaagatttccatgtgatgcttaacaaccttcgtggagtcaaggaaaaaattgatgatttagactcagaaatatcaacgtccggtccactcagaccaacgtttggtcatttattgactcttcaaaaatacatgatagctttgtcaacaacctatggtgctaatcacaaagcgctggatttcattaaaaaaaatttcacaactattaatgacattgattttaccaccgaaaaaataattgatgagatatacgatacaagcgacacaatggatagaattattttaggttacggccaatatttggatgatttggaagatatgataaacaatatgatttcttatcagcttaatatgattatgaaaactctaacagagatatcaatcgttttgactattccagcgattatttttggtttttggggaatcaatgtccatgtcccgtttgaaaaatcttcttatggtgtttttgctgtgctgattatctctgttatactaagcctaatttgctggttttggatgcgacgcaaaaaatatttgtaaagtatttgtgataccctaatatgatttaaagcagaattgctttgttgactttttaaaaggctgattcctttcaataatttaatagcttttgtcaggaattgtaatataaatagacagtggtatttgttatttatctaaatagctttttaatgtattgcactgtgcgcggagaaatattaaaagcttcagcggcttccttcacagtatgagagttagaatattcaaagatagccatattccggctatcttttttttcttttgggtctaccctccttatagttgggattgtgttgccttgcaaatattttaacggcttgcgtacgctcgataatcatatcacgctccatctccgcaaacgatagcaaagttctgacaatcatacgcccaattggggtgttatctatcgttcctaaatttaaaaccttaatcattattttttctttcaataagtcatcaattaagttcaatgcttctctagtattacgagcaaaacgatctaactttgtgatgatcaatgtgtcattgggttcaatcagatggaccagtttttcaaattgcggttgcctggtattacatttcagaggagaagtatagtttgcgagagtcaatgaaccttacgctggattcagaaggattacctgtggcacaagcaggaggacaaaagaagaaacaagatgataattctgatgacattaccatagaatacaaggatcgtactttattgcttgaagtaacattgatggataagaatgccattaaacgtggggagtgggaaccagtactcaggcataccgttaatctttctgctagtcacactgttccggttcaaacatatttcattactgacgctgttgataagaacaccgaaaatatttggcgttctgtggctgcaaccgatttagaggaaaccgctgtccaacatcgctctgttcgtgcaaccatatatcctctgacaattgatacgttgattaaatggttacatgataaaggtgtaaacgaaaaggttatttgggatgccgtagacacttcatataagccactaatcgaaactgatttcgacgctgattggaagactgacatattagcctcgatatcatcgaataactaaatacagaaaaatataacaaatattatcagactaaggactatactagaaaacatcagtacattccttaactcagggtctataactatcaaataacccctcaaaaacattgaaagaataacccccaaaatctataatatagatattgggggttatttgtttttatatggtataaataacttctcttattcgtcattttttcgataccttttggaacgattttgaccaggaaataaacgatcatgcgatccgactcgaatgccaattaagactagttcatctttatcaatcgtataaaccaccaggacatcgttagtttcgcttggtgttttgtttttcggggtgtctcgtaaatgaaattcattatagccgctcattcgccgattaagctcatgatcttcaaattctggtggtaattgttgttgctcaagcaacaggtcaatggctgctcgaacttcatcaataatagatttgtctaaactggctagccgttttagatcagcattaaaggttgcacgtggtttaaatcttagttttttcatcatttaaactgaccccaataatcatcatctgattcaacaatttcatcgtcaggtaagacatggcgtttaattaactgatcacgtgcaattgcatattctaacgaaccttctttagcttttaatgctcgttctagccaatccattttttcttgtgaaacgatggctactgcgcgactatttgaacgagcaatataaacggtttcatcttcgtcattaacttgatctaaatatttttttaggttagcgcgaaaatcgctctgtgttagtgctaatgtcatatttaccaccctttcgttgtacttaatattgtactttaacttgtactaaaaatcaattttttaaggagctaaaactatgcaacaaatcgtcttacccatcaaagattcaaacgtcctgaccgaagtacaagataccttactacacaattttagagctggtcgtcgtaactacacgatttttcaggttggcaaagccaccttgttacgggtaagtgatgttatgcgccttcgttggaccgatgtctttaacgaaaatggaaccgtgcgtcagaatgcgtttatccacgaccaaaagaccggtaaagctaacctgctctacttaaaacccgtgcaaactgatttattagcctatcaagcttggttgcaagaaaaccatttggtttctgactggttgtttccctcgattcagcacccagaacgacatatcacggaaaaacagttctacaaaatcatgagcaaggttggcgatctgttaggaattaattatctagggacccatacgatgcgtaaaaccggggcttatcgcgtttacacgcaatcaaattataatattggcttagtcatgaatttgctaaatcattccagtgaagcaatgactttagcttatttaggcttagaccaggctagtactgaaacgatgctggataaaattgattttggttaggaggctggctttatggatttagattttaaatcaaacaagtatgatctttttgatgattggaatcaaaacaagactaaacaagagtttacacaaaagttgcaacaacaagctcaaattgaaaaaacacacctgccaaaattattgtcgcgtgaagatttaaaaattcgttggcagatgaactctcgtcaaagtgttcatcaagttgctagtaagcctgattttccacaacccgtttttgcttttaatcatggcaagaccccactttacttagcaactgaaattcaaatttttgaaattaatcacccctgggtgataactcccagtgatcgtcttgcttatagtcattggatccttcgtaatgtgattgattaatcttgagatttggctctaggatttttatcgttggcgctagccttctaatacaaataatccccatcgaaatgggtattaaatccacccttgacaagtgtcaaggatgtaagtgcgcattgacctcgtttcactcggtctgctgataaccataaaatcagtttttgctgttgttaaactgaatgtatttttaattcaatttgtacttgcacttaactaagtttgttatgctttagatacttaaaaagtgttgcagattacgctgttttaagccaaaattttttaattgctttgtgtagagaatttttataagcttggtaacaaattttgaataacggtgttgtaagatctgtaaatctaaactgaaagtattattttgatgttaggagtcattaagatggacgaaaagaaagtattaaaaccaattgatgaaatgcttgctgatccttggcaagttgatattcaagaattgtttgaagcttctgtcaatgaacctgacgagatcaaaaagaatttgtatgattccctgtatacttatattttgcaaaaaagacaagaagatattattaatcgtcctggcttcgttatttagccctctaagagcctgctgagggctttttatttttcctttggttaaatatatataaacagtcttaaaaccgctagaaacgagaaataaggcctttaaaaacgaatatagcagttaaagtcttgctaagatttagaaaaactaactgtttgctgtcaatggtagcggacgagcaaagcgtgggagcataaggaattgacagctctaaaccagtcttaacacggaattggcgaaagccaaagtttctataaaactttgctttcttgcctaacggcgagtgaaaaagcggtcaagctggctcagcttggacggggttcggggcgtcagcgccccgaattaaggtggcttgccacaccttttaggcaacgaacagcgtgaggcgcaaggagcatagcgactggagtttaatgtgagccagtttttggctcactcctttgtgttttttgattctaggttttggcctcgtacagtagtgcctcttttaaacctcttttataaacctcttttaaacctcttttagaccccctttgaggcttactctcccaaggcttatagaagtttatcaacgaggttttgtctgtttatcaacgaggttttgtctgtttatcaacgaggttttgtctgtttatcaacgaggttttgtctgtttatcaacgaggtttttaatggtgatcgttgataaacaatcgttgattttatataatagttgtggaggtatgattatgagcaatgaacttataaaatatgatcctgaacttaataccattccgttacgtaaattcacccctattgaaatgaatctatttttttcaattatttctcgtatgcgtgataagggagatcagacagttagattttcttttgaacaacttaaagatttgagcaactataaaccgactgcaaataatcgctttgaagatgatattcaaagaacttatgaaaagttaatgggacttcattttggaagacgtagtaaatctggattaaatagagaaatgtttgttatgtttactaaattcagaattgttggtgaagctgattctccttatatagacattgaagtatataaagatgctttgccacttcttaataatttagacacgtgggttagatatgctttagcggaatttagagatcttcgaagcagttatgctaaaaccgcttttagattgttaaaaggtttcagaacaaccggttatgcttttttatcaaaagaagatttttttgagttacttgatattcctaaaagttattggaaaaaaccgggagacgttgatagatacgttcttaaaccaattagagaagaattaaccccgctttttagagggctaacgattagaaaaaaatatggtaaaggcagaggaaaaccagttatcggttattcttttacttggaaacctgaaagaaaggacgcaaatgatttttctcaaggcaaatttcaagatgagcgtcaaaaactctttaatattcagcacaatgatgaattatcagataaagaaaagtggcgtgcaattgacaaagttaaatgcttgcctttaggaacaactgaaaaacaggtactggctgaaaaacaagctgaacatgatcaaaaaatcagagatcaagcaagacaagaagcacttgctgaactccgaaaggagtttggaaataatgcctaaaacaattagagaacttgctgacgaattgaaggtctctaaacaaactattcaataccactaccaaagactaccaacaaagaaccgacaaaaagatagtcaaggtacaaacatgatcagccttacagctgaaaggattattagggacaaggtagcaaagcctttggtagcaaagacccaacaaacaggtagcaaaaaagtgacaaagactagcaaagaaaataatgagctaattgccactctaagaagagaaatagaagatttaaagtctcaacgtgacaaacagcttgctaccaaagaccgacaaatagatcatctaacaaaattggtggatcagcagcaacaattacaattagcaacagtagcagataaccgtcgattaaaagatcatgtacaaaagctaagtgggcaactaactcaaaaaactaacgacaacttgtcgaccggaaatgatctttttaacatccaagataaaaaaagcaaaatagctaaacagaagattgttaaatctggtattaataaagatggcatacacacaaatagagctattaaacgttggtggaaattctggtaaaagttaatgtaagccttaaggtttcaactaaagcaattacggtcaaccataaccatagtattggattgtcattttattggctataaaatagtaaatcagtaaattttattacaaaaaggctcacaaaaaattattttcttcctccaaaatagcgagacgcttttctaattgcttgacatcctttaacgtctttgattgacccatgaatcatgactggggtagcttgcttgccccaaataacaatagaatcttttgaaggtccaaattcttctgttaatgatttaagtgaacggccttcttggtgaagtttaaccaatgaatctttgaaatcttgtgaataacgaattgacataaaaatactcctatactttcattttacggactgaataaaaatagtccatttttttagtataagagcacttacagaatttatttttggttggttgataacttgtggctttgctttttatactggcaaaattctttttaaaataacaaccaacttcgcattacttttaggaccgattttagccggactcttggttgcaatctattggctggtggtcattatcacgttacctaaaagtttaagaatgcctaaatgatgctctaaagtacattacaggctacaaattgaaatccccaactgcccacaagtaatatatataagactatccaatgaatacttgctggaaatgtacgatttagactagtgcgctgattgataacattctctgtatgagtaaacccaaaaaggataatgtggattgtagtcaatacgtgagacagattttaagagagattaagaaccgcgtttagcttccacagctcaaataaatcattaatttcgattaataacttatttgaaccatggaaagcattaaatcatgcggccatttggttcgcaatcgttgtgatttcaacctgcaagggggtctggtagctgagtgaactatgaattctttttctattataaaaggaatgaacatattcaaagaggactgaagctgccgcttcataattttcaaaaactggaattgggtaaacgcattcctttttgagtgaagcatggaaagattccgttggggcgttgtcatatgggcaacccttacggctgtacgagtggcggatatgtagttcatttaagcgtttgttatattcatcgctggtgtactgcgtacccaggtcactgtgaatgatgaggtcttcagtaattgtccgattctgaacggcactttcaagtgtcttcatgatcagcttgatatccatttttttagaaaaggaatacccgataatccgacgggattgcagatccatgatggttgataagtaacaccaaccatcacgcttggtctgaatataagtaatatcagttgtccatttctgatttaagccagtggtggcttaagcagattgggacgctgttgaatcgcttgtttggaggaagaggtggccttccacttcttgatggtaatcgagtgaatatccatctccttcatgagccgagagactcggcgaggactgcagcggcgctgcagaggttgaagttccttacttaattcatagtgaatcttcatgacgccatatctttgtttgaattcaacgaagatgcggcagatccgctgtttcagatctttgtcttccagacttctttttgagggcttgtgggctttatagcgatagtaatgcgctcttgaaaccccgatgactcgacacatcttagttacctggtaattttggctttcttgttggatataatcaaagatatcggttatctctgcgcaaggaagtcgagggctttttttaagatttcgttctcctcggataaagcagttaagcgtttctccattgctttaatctcatcaggagtcttacctgacttgttttgagtttgggcttgggcccacttatgaacagtggaatagccaatgccatgttctctggcaagttgagcagcggattcaccttgtttatagagattgataatattttgtttgaattctttgtcataatgagttggcatgtaaaaattcctttcttttaagagacgattgacttattataccctctcttaaaagttgtctcaggaactagcttacatccaacagtaaaaatcaaactattaggaacatcacacgattattaaaaatcagtcaaaataggaaataattttaaaatatccttttcatgatctttcacctgtcctggattttagaagtatcacttggtttctcaattaacttaaaccgtcgctgctgcgtacgtttactaatccccgtctttcgctcaatcattttataggtcataccctgttttcgtaactcgtaggcaaatctgatttgttcctcagaatacgtttttggtcgcccttcccgaaacaacggatcatgttgcttggcatacaatttaccttcttgcgtgcgcgtgacaatcatatcgcgttcaaactgcgcaaaagcactaaatattgtaaaaatgagttggccagtcggcgtattatcaattaatcccatattcaaaatattaactttgacattttctttaaacaactcttgtataattgctaaagcttcgcatgtattccgcgcaaaccaatctaacttagtcacaattaaagtatcacctgtttttagaacccgcaatagtttttggaactctgatcgttcagtagttgtgccggtatacttttcttggaaaattttttgggcaccggctacttgtaatagttcaatttgatttgctaatttttgatcagtagtactgacccgcgcatagccatatttcatcttttatctccttacttatgtcattaagtaatgacacggttctatccctttaattatacagcatcaaaaaagaggccacaactgttaagttgtggcgctgtttccttcaactgctgattactgtttttgacattttgctagttatagatctacatgttgctctctgaaactaacacgagcgtaaccaatttttgacacgttaagaatacctagattcaatttgtttggacaggcaaccaattttgaaactattttttaattcggtttagcatatattcggcaaacatatttagatcaccttggttgaattttccctcttctgtagccttattagtgtaattttttatagccttttcaatcattggaacatacctttctgacaaacaactaattccccacgttcctgctgccagtttagaagtaataatttggtcttttttatatactagaactctacataaattcaaaactgtgtacgtgggttgctttatgatattttctctagcatttgcaatatcaaaatagatacttttccaataaagctccttagggacagaactaaaaacagtatttattggctttccaagtaggacttttccaaatttattagtaatcataatatgagctgctaaatcaggatcggttccatgcatgttatttaaatagagttgcttatttgttaaatattccttgtagtgtgctttggaaaagtgaaaatcaaacggcataggatgagaaaaatgttgagtatcttttaatagcaaaacatggaattcaagtcccttagcaggagcaatgggccatagttgttctaaagttaaactcatcaaccgttgtttagtttttgacgacaatggttgtttaacaacgaccaaatagtctaaatcgctaactgaataattgtaactacctaaaacatatgaaccatgtaaatatatgccaactaaattattcttcaaaatttgagaataaccagatttcattaattttagtaaatttgcagtatctgtcattttttctccttaagcaagcacgtatttgaacagttctaaatggacatctataaatccaattatagaacgaaagccaaaatggccactagggaatactcttgtggccaaggcccccatattgacaaaaaaaacaattgttagtatcatagtggtgtagagaaatagagttagtaatattatacactgtgggctagtggatatagcttgcacccgcctgtgggcttcttacttgaagcaaaagaatagcaggactaccttcccttgaggtaagatagggcatatctagcgtgaggtgaaactcaatacgtgaaaagagggatattttagatccttcttttttttttaggagattatggatgcatgaattataattgtgattttcttaaaacatttgacggttgtatgaaaccatctcaagttaacatggcacagttaattaacgtcattgaaactaatgtttcccaatataaatatcattataaaacgagtttaaaagactatcctgaaattaccattgaagttactaatgcaaatattcctcatttacttggcttatctaaaaatcatcacaatggattacccgattataaggcaggtgtaatttttgaaggcctcaaggacgattggactttagataacctaaaaaagggtgataatttttggtttacagagaatcaagataaaataataggagttctattactttaccaaatttttcatgtacaagaatgcaaaatttatagtaccaaacatattattaaccaacctttgggaagcaaatttaagcgagataatatccattttattatatttaaactagcaaataataaggattattcagtagaattatccccgataaataatagcgaaaacacatatttccctagaagtttgaaaataaatgatactcgctttactaattgtggagaaataaatatgcaacttgtaagccaacaacgtattacgaccaaaaaatctaaaatgaaacgggttaagtggaaactagatcactaattatatgtattaaagcaaaaggaaatcagcattagctgatttccttttgctttaatacaatgtcctgttttcaaagtgaaaattaactagttttaaacacaaaatatcgggagacagtgatagccaacaatgattctctcacgaggagtgtcagtttgcaattctgttaatgctcaattctttgtatatttccatcaagcaatcaattgattgctttaaattatcttcactccaaacatttttatttttatcagcaagagtttcaggatgatcaatttcgtttcgaacaatgtaaggtatagttcgttgttgttcagtttcccacgtaccacgcactctaggaaaaaaagatttagtcgatagggactgtttaatacattctggtttcaaaaaagtatcatcaaaagcggatagacaagaattatcggggttttcattacgaatccaataaatatatatttttgtgaataatagctgatgaagatcaacatttgggacaccaaaggccctgtaggtaacttcacctattgaagtgggggaaaacaataaggaattaacggagtttatttccttttgattactttctttttttagagaaagtatgattatagaatcattgtcctcacgataatgtcttagtatatatggtgaatgtgtcgttataaacacttgattaccatttttagataaattcactaaagaatctattaacttatcttgtgccttaggatgtaagtatatttcaggttcatctatcaagaactgtgtgttctcatctttggtactaactttcgaatagacttgaataattgctaaagcaagagcccgttgcaagccatttcctttttcagatatgtcagtttctataccattctcggtagatactatatttcctttttttataagatcatttacatttggaaaaccaaacttaaacttaatcttggaattgccaaactgattacttaaaatttcatctatgttgttttctgtgtcactcaaatattttttaatgccgttgacgccaaaggcatctttatgagccctttttaaggcagcaaactctgggcttgcttggaagtcttgggtaattgtttgaattagtttccccgttgtcttagtggttccaaaatcctgatagtcttcattatgcatatcagcgtagacaatttgaggatctattaggtcagttattgtgttaccaatacctgtggggttttcaaactgtttcttttggaaattgaaaattcttacttttttaatatcaaatttcacacttttttctttaccatcttttccttgcttaacagtattttcttctgaggaccttttaagcattaactggtggttctcgatatatggattatacttttttaaagatccctctagaggattaacatcatctataacgatagtaacactgacgttttcttgctcatgaccctttgatataacattctcttttttaccacctgttgttaaaaaatccaaggagtttaagatggttgttttaccaacattattatttccaacaagataatttataccagaagcaaattgtatttcaatatcttcatttttagagttatctgatgaaaaagatttaaaattatgcaaaactattttcttgatgtacattattttccccttccatagaaaaacatatattgttatgcttcttatatgaatatttcttgataatcagatacacaacaattacaaagttacataaaggctgtaaacaagaatgctattttttaaccattatccattcctttgaaatagcattttcgaaaattccagttacaaacgcatcagcatcaatcactgcttttgttgtaagtattttcctatgaacaacgacttcgatactatgaattggttttagatcgcgtttaaccaatacaaaagaatctgacgtatccagtttgaattttggtttacttgaattgtttttaaattgtctttttacttcatcacccaataaatatttatctcttccaaaactatctagcacagtgagtttttcgggtggcggaagcagctgttttgaatcatcttgagaaattcctactatttgcacatttaattctaagctgctaaaatcaggaacgttcatcgtaagattaattttcttaattctatcagtccaatcagcatctgttacattagtgactttatataaatctatgccatgagctttagcgtactgaatagcgcccttttgaaacccagactttgcaaaaaaaataccatttactcccaaatcctcatgagcaatactagataatgtggcaactttttctttgccaactggccttgtataatccttacactcaacaatcataggaatctttgttcccttataatcatagtcgaatgttatgtcaatttgattgttagtatgagcttttcctttttttagtacattatgtttaatattactaaatggggcccccgtaccagctaatttatcaattaacgttttgcaaaatagttcgtatccttctccccttttaaccatgctttttcccccttttaactcaaaaacaacaataacatagaaaaagtcaccctaataactctgaccggttacagggtgacaatataatattgtaatctaagccaccacacggaaagctgttttggaagttctttgccaccaaggattttttataactcatattatagcatactctttaagttgtttttttgcgttcgctcactaattttgtgtggagtggttgctttcttaatttgttgttctaagccctggtaggaattattaagtgtttgtgtcaagatgttgttataagcgtcagtctcggttagttctcaatcaatcacgtctggccggttaagaaaattaagataggttgctaagatgttgcagtcatcgaatggtcatgcgtccgtctaagaacaggtataccgcgtcattaaaatcattagtaaagtgttcagcggtatctttgataaactaatcaagaacgctagggttatacattggatagtacattttatatcctcatattttccctctaccaaccgaagggcggtaggtaaaatctaatcaaaatcaacacttaatttatggccaccttcaagctttaacttagcgtcaaacgacttcccctttttgcttttgaatcggcaaattacaagtttaatccgaacaagcccggaaactttcaatggcagtctgttgatgatggatttttaatggtcgttgattaataagctcaagtgctgccaggatttcatcagtcgttatctggtcaaagttagtctttttcgggaaaaaccaacgtaaccgtcgattgaaatattcattggatccccgttcccatggtgaatacgggtgacaaaaatacactttaatctgatagtcttgttctatggatcgataatcggcaaactccttaccatgatcaacagttatagatttcacttgggaaccaaagattcccataaactttccaaaggtatcatttaaggtcttggcggtgcgattaggggctttgatagcccatagaagccgggttttacgttctacaaaagtgaccaaacatgctcgtgactgacctcggctagaaagtaccgtatcgacttcccaatgaccaaaagctaatcgctgattgacagattttggtcgttgttcaatggaagtcccacttgtaaatgtgccacgatgctcattagctcggcgctgtcggacatttcgattaggtagatcagccaagttgaaaggtaaccagccaagcttaagccagttataaattgaagcggtgctcaggttaaaagctgtcgcaatcgcttctggtgaccaaattaaacgtaggtggttggtaattaaaattgtcaatgatggcgttagaattgaatggcgaccacaagcccgccttttatgatctgcgtcttgttgcgctaattcgggatcatagggtttaacccgatctaattcatagctaatagttgatttggcaacgcctaaggcgtcagccatatcttgataagtatgatggccttcactgaccagttgagctagcgcaccacgttgaaaacgtgataaagtagaagtacccaaagtaatcactccttatagctggttggaattaactactaccattgtaagagattgctttgggcctttttttatttttgttcgaattaattatagaatttgtctcacgattaataacttatttgaaccatggaaagcattaaatcaggcggtcatttggctcgtaagtgttgcgatttcaaattgtaagggggtctggtagcccagtgaactatgaattctcttcctattgtagaaagcatgcacgcttggcttcactcaaatcattacgtaaactatgattttctacttctagatgaattttttcaaagttataagcgtcgctagtcaccgcccgttgttccaaatcagcaagatcaaatttatcaaccgtgactttatttttattcagcaaggtgggtttactagcaatttttttggtatcccgtggtttgatttcatcaagctgctttttagtatctgcaagctttgcttgtgtctcttgtttttcggtctctatttttttcaattcttcccgcatagctttgtattcgggtactgataaattcttacgctctttatttttgttaccacgttgaacatcaaagccattttctttaaggtactgtggtaattcctcttgaatgcgctgtaaggcttcacgattgaatatacgcttagctgagagctttttatcattatcaaagggcacaatgcccatatgcatgtgaggggtcttctcgtccagatgaacaactgcatagcgaatattttcgtcaccatagttatctgcaaaatattgtttggctgtttcaaaatatttacgggtttcggcttcgtctaattgctcaaaaaaatctttgtcactggttataatccactcattgactaaaacagcgtctttgcgaactgcccgcttactcgctttgttttcgttgatataggcttcaatatccgttttaaagttatcagtgcgcccagccactaaatcataattcaggtgagagcgggaaacatcaatatcttcgttgctgtgattagtcgttttccgttggtcatgattgccaatgccgactaaattatcagcttttaatttcgtcattctagccactgcaaaactcattgtacgcacctcatttcggagctatcttccaagtaaagtataacccactatactttacttcgtaaaggtgggctcgccgaggggtcttgcagacggctctgtcggctcttttgagccgagtatcagcgcaccctatggtgcaattagctgatacctgtttgacgttttgctgccctacttttttaagtaggtatgcaaacctcaaactaaaataaaaacccccttcgacttttgtcaggggggcttttattaatcaataattctatttaaagtcgcatgacaattggggtaaagtgtagacaatatcgctacgctctcttgcccacactttacacttgtaagaggggcgcttcgcttcccctcttaactcccctcaaagtcaaaaccgtgtcgattgcgcttcgcacaacgcccccaaagtcaaccccataacaccctaccttttgacaaaaggtagcccaaaacaaaacccctttaccttggcggtaaaggggtgctttcgcaattgtcagcgtggcttttccacgtgattcaattggcgaaagaaggtcaacaactcgggatagaatgtcttgtagtcaattttgttgccccaattgtcgacagtccatgcttcgagttgttgctggaattgttgcgcttgagcttgcaattcagcgggtagggcgggcttatcggcagtttccgcggttcgcataaacttttgataagctgaaaaggtctccataccttttttggtcactatatcatgaccaatcttattagccagttcttgttcagcctgtgctaaccgttgtttcatagtgggaatatctaaagcctttgacataataaccgctcctttttcagaatactgcgttgatagcaaggttttggaaattggtcaagatcgttaaccagtttttatgcaaaatatctaactaatacttgacatttacattgagtaggaactagaatgaccgcgtattaaaaatgatttaagaagaaggagatttttatgatgaaaaaaattgaaaaattaactgaaaaagaaatggccaatatcattggtggtaaatactatggtaatggggttacttgtggtaaacattcctgctctgttaactggggccaagcattttcttgtagtgtgtcacatttagctaacttcggtcatggaaagtgctaattaattaatgggggggattatctttggctgaagatactcgcaatatggctgagcagtacgtaactgaactatataaaaaattaaagtctcgagattcaaaaacatctggccttttagatattttagatgttcttatccaagttcaaaaaaacttatcaacggtgaaaaaccctgaggcattagtaaatcgttgcgttcaatatatacgtagtgttgccatcaaagacaaattatattttcctccagcagaagaaaatataattattaatttagaagttattggccaaaaagcaggttggaacggtagctatatggctgattttagtgataaatcacagttttataaactttcagaatcaatcccacaccattagatttgagcttccactatattagtatttagcctgatagatggtgaacgacaagattgcgtagtctacaataagattgctagtcaagcggtagtagataagttacattttactgccgaagaaaacaaagttctagcagccatcaatgaattggcgcattctcaaaaagggtggggcgagtttaacatgctagatactaccaatacgtggcctagccaatagtactgataaaggggatattgtagttgtctaagaaattttggtcaaatatctttttagcattaggcgtctttcttgcttttgcaggagttgctaccatatcggtgagtgctgacagttccgctactatagaatcaaatactagctcgaaaatcatcgatggtgcaacttatgaagaaaacatcaagggcgttattcctattacgctaactcaatatttgcataaagctcaaactggagaaaaatttattgtctttgtcgggttcaaggagtgtgtgcattgtcgtaaattttctccagtcatgaaacagtacttacaacaaagtcagcatcccatttattacttagactatgggaacaacgggtctttcagcatggcttctcaaaaacaaataactgatttctattcaacttttgcaacccccatgagttttatgggaacgccaactgttgccttgctcgatcatggtaaggtggtatcaatgaccgctggtgatgataccactttatctgatttacaacagattactgctgattacaataatcagtagtcacctggttaatatggttttgtaaccaatgtaaaagacgatggatctttgaaatcgtctttttttatgcacaaattttaaagatcggtggtttgcttatgtggactcaaaaatggcacaaatattatacagcacaagttgatgaaaatgactgtggtttagctgcactaaatatgatcctaaaatactatggttctgattacatgttggcccatcttcgacagcttgccaaaacaactgctgacggtacaactgttttggggcttgttaaagcagcaaaacacttaaatttaaatgccgaagctgtgcgtgctgatatggatgctttgacagcctcacaattgccattaccagtcattgttcatgtattcaagaaaaataagttaccacactactatgttgtctatcaggtaactgaaaacgatttaattattggtgatcctgatccgaccgttaaaaccactaaaatatcgaaatcacaatttgctaaagaatggacccagattgcaattatcatagccccaacagttaaatataaacctataaaagaatcacggcacacattaattgatctagtgcctttattgattaaacaaaaaagattaattggactaattattaccgcagcagctataacaacattaatcagtattgctggtgcatatttctttcagttaattatcgatacttatttgccgcacttgatgactaataggctctcactagttgccattggtctgattgtagcttatgctttccaagcaattatcaactatatacaaagtttttttacaattgtattaggacaacgtctcatgatcgacatcgttttaaaatacgttcaccatctttttgatttaccaatgaatttttttactactcgtcatgtcggtgaaatgacctcacgcttttctgatgcaagcaaaattattgatgcacttggaagtacaacgctcaccctttttttagacatgtggattttattagcagtagggttatttttggcctatcaaaacatcaatttatttttatgctcgttagttgtggttccaatttacatcttgattgtttggctatttaaaaaaacttttaatcgtttaaatcaagatacaatggaaagcaatgcagttcttaattcttctattattgaaagtctcagtggcatagaaaccattaaatcactaactggtgaagcaactacaaaaaaaaagattgacacactattttctgacttattgcataaaaacttggcttatcaaaaagctgatcaaggacaacaagctatcaaagcagctactaaattaatcctaactattgttatcctttggtggggtactttttttgttatgcgacaccaactgtctttaggtcagctgttaacttataatgctttgctcgcttacttcttgaccccattagaaaatattattaatttacaatctaaactacaagctgccagagtggctaataatcgattaaatgaggtttatctagtagagtctgaattttctaaatctagggaaataactgctctagagcaactaaatggtgatattgaggttaatcatgttagttttaactatggctattgttctaatatacttgaggatgtttctctaacaattccacatcatcagaagattactattgtaggcatgagtggttcggggaaaacgaccctggccaagttgctagttggtttttttgagcctcaagaacagcacggtgaaattcagattaatcatcacaatatatctgatattagtcgcacaattttacgccaatatattaattatgttcctcaagaacctttcattttttcgggctctgtattagaaaatttattgttaggtagccgtcctggagtaactcaacaaatgattgatcaagcttgttcctttgctgaaatcaaaactgatatagaaaatttgcctcaaggttatcatactagattaagtgaaagtggattcaacttatctggtgggcaaaaacagcggttatcaatagctagagcattattgtctccggcacaatgtttcatttttgacgaatcaaccagtaatttagacaccattactgaacataaaatagtctctaagctattattcatgaaagacaaaacgataatttttgtagcacatcgtctcaatattgcgtctcaaaccgataaagttgtcgttcttgatcatggaaagattgttgaacagggatcacatcgacaattgttaaattataatggttattatgcacggttaattcataagcaagaataacctatcaagaaccagtctgctattgatagactattcttgtccgtaaaatcctcgcgtattcccgtgaggatcatagtatatttagcgctcttcttaaaattttaagtatattgattcatatgtttatccacctaagtttgaggacaaaccggtacatgttataatacttctaccggcttgtccggtgttgggagcattactcgaacttttctgtggtagtcaagtgagtaatgctcttctaaagtgcgctgaaataaccattgtgagtggttaatcagtgctttaacatgttgcgtaagtcattaagggtgtctgtttcggcggccttaatgactttttttatttttctgttttcttcgggcttagtgacctcaatcatgtagcctactaccgaacgcttatgctttaaggtggttacggtaaaaactaggcccatcttttgatagagttcatcaatagcaacattgatggtgtcacgcataaatcggccagccggccaacggcgattagcaccaagaaaccaaccttgccaatcttccatagcgcctttgattgtaacgggattttggcccccaatttgattagcttcaatgagcttgagcatgattaaactgtatttagatttcactctcgccaattcacgaagcttaaacgagtaatagttttttctcaaatcaaaaatatatggagcggattcggttgaaaataggaacttgacactgccgttttgaaagaaatcaatgtgactgaatagttgtgtcatacgaatccctttaacgccattttcttcaattctgagatagagagctgttttctcgttcaaagccttaaaagccttagcaactcgttcatagtctcggccagaagctgttaaacctaaatgatgcagtatatcaatggcattcactgaatattcttcgtcaggtttgctatctttggttacgaagctaaaacaataatcaagaacacgatgttcaaaagctgatagattaccgaatgctctagctaaatcattgccttgaacaactaaataatcctgtcgcgacaataaactagaaagtgcaacatcagcctttttagatattttcccttgcatgaaatcacctcctaaagggacgtactaaaaagtcatttatgagaacaaaaccaataataaagcatttatattcatttgtcaaaaaacctcacacttcacgtgtaaaaacctcacacttcacgtgtaaaaacctcacacttcacgtgtaaaaacctcacacttcacgtgtaaaatcctattttcggcgtctgtaaaccgcatggttgaaccattttgacggcccctaaagtatttaaaagtatttaaaagtatgtgtgaaagtaaataaataatgcgcgcgcgcgaggaaaaaaattaaaactcaaaaaaattgaacttgaggactggtcaggggacgtaacgccgtccccaattcccccctcactcaaaaaggagtgagcgaagcccacgctcacatttaactgcgcctcccgttggtcgttgctaaggtcaaacccgcggttaggaaaacttcgggcacgccctcaggcagagttaaccacggctagtagctaatttagtccttactattcgcagatagtgctaataattgcttgaaaaaaacaatcaggttataataattatgcaaagaaagctgaacataggtacaccaaagccctcaacgactgcaattcgttgagggctttttgggtgggttataatgtcacctaaatgctttacttgttgtgcttatggtgtctaaccaatccgcaaaccagacactaattaaagcgaccaacaagggggcaaagaaagctgaaaacatagcgtacacctccaatccgtcacaaattgggttaggtgacgctcattagcttagcataatttagtgttctaaagtgccatatacatatatctaataacgtgctactagcttattctgtgcatggagttcgtgatcgttcatcgctcacgcccgcggctacgtcttgatggatactgtcggttaattttgttttgtttagtttgtttggtcaatgtgcttaacttctggtctttaacgctctgttcatccttcttgttcatggcgattaattgactaagaatgcccagccgtttatctatgaatcggccaacttgtcttgtaaggcgttgtaagccatctgcaattggtttaattgcgattgtaagacggtcaatactttgacttgattgtgtagttgctggttttcgttgttcaatgtctcattctcgctgttcaatcgctgtatttgtgcttgttgcaacttgatggtcttgtccatatcagtcacttctttgtgagagctaagatagcttgtttctgcttctcgactgtattttctaaggtggctaatatcggggtctgaaagcagcaagcccctttaattcgatttaccgttgacagacacaaagttaactacgttcaatctagtgagatagtacattaagctcttaaacgccattttaagctcgtataagcgatttaaagatgtgggccgcctaattcatcagatttatgtctgtcgagttcctgtgagctttcaggggcttttttagacggttcttttagtcctgcacgctctagccacttgtcaggtaaattaatacctagttttttgtgtagaaactcatcaacatttcgtataatgccttgaagcgtttcgactagtttttgcaatcgctcattttcttttctcagttcatagttgcggccgatttaacgacgacgttactccaaattaaccagcgaccgcttaaaatgctcgactggcaaacaccgtatcaggttatgctgacaaatttgtccaaaaattcggattaaatttgcaatctaccatattaataattctagtttttgcaattccatttaaattgtctacaatgaaagtaagctttcttaacatcgtttatggaaaggatgacgcaatatggctcaaaaagcttctgaacaattagtcgacgtcttaattgattggcatgtaaaacacgtttatggactaccgggggattccatcgatacaactgtcgatgctttacgcaaacaacaggatcagatcggatttgtccaagtccgtcacgaagaagttgcttccttggcagcagcggccgaggctaagttaaccggtaagcttggtgtctgtctttcaatcggtgggccaggcgcaattcatatgttaaatggcctttatgatgccaaaatggatcacgtgccagtactggctttacttggtcaggttgatacccagtttttaaacgaggaatacttccaagaagtgaatacaccacaactatttgcggacgttgcggtctataataaactaatttctgccactgacaatttagctgaaatcgttgatgaagccattcgaacggcttatgagaaacatggagtcgcagttttaaccattccggataaccttccggaaaaaagggtcagcgaccactatatcaattccgcttcttctttccaattgacatcaccacaaatagatgacaatcgccttaatacagccgctaaactgattcgtgattccaaaaaaccgcttgcattggttggcttgggggcaaaaaaagccggcagccaggttgcggccttcttagagcaaaaccatattccgtttatttcaacgttgcccgcaaaggggatcattggcgacaatcatcctaattcgctgggaaatgttggtaagttggggacaaagccggcttatgaagccatgcaaaataccgatctgcttctaatgttcggcacaaattatccctataccgcgtacttgcccaaaccagggacggccaaaagcatccaaatcaataccagttcgtcagcaatcggaaaacgttatccggctgatgttggattggtagccgatatcaaagacgttataaagcaacttaattcttctgaaacaaagatcctccatcctgatgatggtttcttaaaggcctgtcaggaaaatgttgctaactggaatcgttggatgaccggcaaacgtgaaatcgattccaagccagttgcacccgaagcattatttaacgatattaatgaaacggcaccgcataatacaatttattcaattgatgttggaacagccacctcttggagcgcccgtttcttaaacgtatcaccaacacaaaaatttgtcttgtcctcttacttagggacaatgggatgcgcattaccgggagcgattgcagcaaaaataaattatcccgatcgaccggttatctcggttaatggtgatggtgcgtttgcaatggtcatgcaggatttcattacggcagttaaatacaagttaccattaattaatatcgtactcaataattcaaagctggcctttattgaatacgaacaacaggccgccggccaattaaattatcaaatcgacttacaggatatggattacgccaaatttgccgatgcggctggcggtgttggcattactgctaaaacttccgaagaatttaagaacgcattgaacagagcctatcgggtccagaatatgccggtactgatcaatgcttatgtcagtgatgatgcacctttgccgggcaagattgtcggtcaggaagctaaaggatacatgaaatttggcagccaatatcttaaagaagagaaaaaaatacctgaactaccaccactaaaagatattttgcgccaatttttctaagcaaaacaagtaggccaccgaattcaaaggaaaaaatcccaatcactatttgaagtgtcttttaacaaaagcctttcggcactaatagatatattgcatagtgatttgttggtgctgaagggctttttggtctaaaactcaggattcacctagaatttattgataaatgatacctgaaaaagttaatttgaaatcttcgtttttgacagttttaagatagccgtgataatctggaagtttgtcaaatggtgttgaagaatagtttctatcttttggagatctcctcgtgtgggagatcttttttgttgttttattagttgcggcgtttaatcttggcagtcgcgatatcagtattgttaaaagtggctttaacagtatctaaaagaatctttgtatcttggcgagtccaccagttgccaaagcgattagcaatctgctgttgggtacttgcaccagaaattaaatctccccagtcagtattaccgaatgacttgctttgatacatcttaatgccttattccatagcagaatcaacaccattagtttgaatatcgttagtatcattccattcatctgcatcaccgcttaaatcattcattgcagggatctcaactgatcgtcctgtttgaagcaatcggccacctaatactggatcgttttttagcacaccagattgaacaaatcgattagtttgagtattttgacgatagatccagtctagaaagactgttggttcaattaaattactaaaattcgtagggtttccgttaattacggttattacctacacctcctatttaagtttgttgtacaaatctgggttttgacgataaaggttagtctgctcttcaaggctcatctgcgcaaaattttcgcgtgtcatagaagcgttaaattgttgaccgccattctgtggtgattgattacccgtaactttcttttcaacagcttcctgaactgctttgttaaataagtttgtaaacttaactaagttattgttacgaacatcttctttaacatcactaataaactccgcaaattcagctggaatgtgcttgtcagttagaacagttttagttgcagctaaagcatccttacgatcagcttcatctaatttttcttgaagacggtcttgctgttcttttaaggcttgtcgttgctcttctaaatcggcttgggccttctcactagcattcatgctggctcgtttttcacccttttcaagccattcttgttccttttgcttaagctcccttttcaaaatcatgccgcagattgctttctacttctttagccttagaggccatcatctttccaatatcatcctgtgtgtaggtcttgccagctggctttggatttttaccatcaggatttgggttggaatcgtttggcttaggttctgggttaggatcagcaaaaaattgcaaatttgttttcatcatcaaaactcctttttaagtccgtagactaaattgtttgtaagtgcaataactaaatcaattattctttaacgcctgtaattgagaaaaaggcaaatcaaaaattcctattttaaaaagaatggcacaatcgaataacttgtatgcaaatattcaattgtctataattagatttagaaggatgcaatttagataatggaggatttcatatgaaaagatttggactttggtcaaaaatatcaattatcatttctatatctcaacttttattagccatttttaaagaaattcaaaactataacaaatctaaaaaacatccttcgaaaaataagagaggatgatgttttatgcattggttatgggttttaattattggtgccgtcattggtgctactgctggagcaattactagcaaaggaaaatcaatggggtggattgctaatattgttgccggattagtaggttcctctattggagaagctatactcggatcttggggccctcaattagccggaatggcaattattccttcaattattggagcagtaattgttgttgcagtagtttctttctttttaagtcgtagcacaagataaatttttccctatatgttaaactttttaacaatcttttaaatgaatctatggttgttattagctggtcaattactgtagtaattggcttttttataaatgttttactttaatttcatgtaaagccactctaattattaacaagctgaaagaagtggacaaattggccatgcaaaatagaagtggcagaaaatatggattattaaactacagtgtttacgtcatatctttgggaggattcctatttgggtatgatactggtgttatcaatggagctttggcttttatgagcaagactagccaattaaatctaactccttcccgtcagggaatcgtgtcaagctctttagtcttaggggcttgccttggtgcattcctatgtggaaaatatgctgataaatatggcagaaaggttacacttcgttgggttgcagttatctttacactggcaactgtatgttgcgcattatcactcaattatatctttatgaccacatttaggtttatcctgggactagctgttggtgctgcctcaagtctttctccaatgtatcttgcagaaatatccccaagggaagttcgtgctagcaacgtcaataagaatgcaatttttatcgttttaggacaactagtagcgtttattatgaatgcccttttaggcagtctatggggtaactgggatccaatttggcgcgttatgattttaatggcatgtgtcccctctattatcttatggattaattcattcaatattgctgggagtcctaactggttagtacaaagagggcatttaaaaagagcacgcaatttagctcatcgactaggcttcaaaaaacaaactgctaacaggatcattgatggacgtaaaaagaatatcaaaacagagacaaagctcacttgggaccaaatcttttcgaataaacgattagtctacttactcttgattggaatcattattgccttgattcaacaagtatccggtgttaatacagttatgtattatggcactatcttgttagaaaaggttggtatgggagaacggggttctttgtatgcgaatatactaatcggcttaacatctgtcatcgctagtatctttggaaccagaatgattgccaatcacaaccatctgaaaatgttaaaaattgggttaatgggtaatattatctttttagcattgttaggggttatcatgcacgcaaacatggtgccacaggtagttacaaatactttggttctaacaatgcttgtcctatttctagcgaaccatcaaggtattgttagccctgttacttggttgattatggcagaaatgttccctaatagtgtcaaagctagatttatgtcaattgctacagcaaccacatggatcactaatttttcaattagcttagtttacccattgctaattaatgctttaggaacagccactgtcttttttgtatttgccataacaaatgggtgcagtttatttctttccttgactgttattaatcaagagaaaatgaaaaaatcctatcaggaaagttccagcaaataaaattaaaatgaggaaaataatatggctaacttttatatcaatcctaataacgttgtacacgaattgcctaaaaacaatcagcctaaattttttatgtttggtgttcctagctacaccaatcttggtgaccaggcaatatcattagccgaacgaaaatatgtcgaagctgagtttccagaataccaatatattgaaatagtggaggaagatgatgatgaggctatccctgttgtaaagaaaaatctaagtagtgcagatattattgcctttacgggtggtggcaatatgggaaatctctatttagaccatgaaaaagcacgtagaaaagtattttcaacttttactgataacctaactatctcattcccacagtctattcattttgaggacaatgaagctgggctttatgaacgaaagttaagtcaagaggcttaccaaaaaaaccccaatttagttttagtagcccgagatgcacagagctaccatagaatgcagactaccttcaataataaagtcatttttacacctgatatggttttatatatgcaatctaagcaagccccaaaatcgaagcatcaaggatcattatttgttctcagacgggacagtgaaaaagttgtcaaagataaggttatccaaaatatgaaggctttgctgagagcctaccaacctattgaatttacggatactgttttagatacggttaaaactattacacctgatacccgtgaaaaattattcagaaaagaattaagcctattttcaggtcaaaaattaattattactgatcgatggcatgcaatggtattctcagttttaactggaacaccttgtttactaatgggaaacagttatgggaaaggtaagcacgcttactttgattggctagagcatatcaactgggttagttataccgatgaggaagataccgaaaggattaaacaacaaataaacgcgctcatggaagccaaaactcacgcttatgatcttattcctgattttaaacagttacatgatttaattgcacataatcggtaggaaaaagccaactttttgataacgtttttcatttgatgttaatcaaaaaattggctttttatataacttttttagtgtatctcttaataaggtggtcatatgaaaaagaaaatcaaccttcaatgcatattattaacatttctaacattcacaatgggtttgagtcaatttattataataggaattataaataatttatcgacagattttagagtttctatcgcagacattggggcactcgtaaccatatttgcaatcgtttatgcagttgcaacaccaataattaacttatctattggtagtatcgctttgcataaagttatgctcttttttatgctgattttttcatttggaaacttattgacagctatagctagtaattttaatgtactacttatgagtagaattataacagccctatcatctgggcctctgatgtcgactgctgttacctttgcagctgcaattgctcctcagagaaaaagagcttggctaatatcttgggtgttctcaggcttcagtatcgcttcagtttttggcgtacctttaggtacttggataagtgataaccttaactggcgattaactttttggacaattttttttgcctcagtctttattactatcgtagttttctatttgctacctcataatttaacacaaaatggaacacataatatattcaaacagttagctatcttaaaagacaaaagaatcatctggggtattctggtcccggtctttaattttagtgccatttatatcatttatacctatttgaagccaatattaattaaagagttaagtttctcccacaataatgtcataattgttctatttttgtacggactatgtggattggtaagcaaccaagtgagtgggcgtatagcaaacatgaaatggaaacgcaatttaaaaaaattttttattcttcaagctattagtatctttcttatattcataagtggaaatttaacatggctaaaaatcagtgccattctcataatggctttaacaatgtctatttctaactcacccatgcaattgtattacatggatattgccaaacaaaattatccccaatcattggttttagcttcttcttttaattcaattttttcaaatgttggagttgctaccggatctgcaattggaggatatgtcgtggccactgtaggcttaagcggtttgggcattgcaggtagtgcctttagtgttttcacaataggtgttctaacaatattaattaagtataactataattaataagatcttttaatgcctgtactgattttggcaattattattcaggttcagtataccagagaataagtcttaatatttatgttagcttcttcatgtgaggatagatagaattttaataaaccatcagcccaaatttttatgcttgtaaaatagcaagctacaggatagtatggtggttttaaaattgactcgataggaaaacaatttattattataaaacaccacttaacaaaaagattaagtggtatataggagcaattaaataatgaacaatcgtcaattaaggaatatcttgtatattatgaccctaatatttatttggtagattgtaaaattaatccgaacgctgtgaaagtattttatattgataaaaattagagcgtgctcgattagttacgtatagctgccagccttgtgtatggtctatcaaagagaccaggtaaacaaaacctttaagccgaaaccctattttgaactaaatgctgaaattcttgctaatcagcaaaaatttgtcgcaaaactagacccctatcagcgatttaaagacgaaacagggctaatgacattcatgcaggctaaacacgttcagaaaggctcacaggccagtttaatcaaggacgtccaaaagcaaggcaaaaaacgagctagtccacaactattctcgctatctagtctccaaagtgccatgaataaacgttatcacgccagcgccagccaaaccttagcggctattcaaagcttatacgaagacaaactgctgagtcatccccgcaccgattgtgcttatatcactgatgaagaatttgattatttagtggctaatctgacgaagtatctgggtttggtctctaagccagtcgctttaaccaataccactccaaataagcgctatgttaatggaaaaaaggttgaagaacactacgccattatcatgactaaagtcgtgccgacgaaagagaaactagccagcttacctaaattacagcaacaggtttatgatttagttttaagaacgacgttagcgatgtttgctaatccgtatgagtacgaggaaaccaccattatcacccaagttggcgacgccaattttaaagcaacgggtagggtcccaactaagcaaggttggcaagttttatttgatgatcacaaagccgaccagcaagagacagccaccctaccgatcgttcaccaaggcgaccaagttcaagcaaatctgcaaacgccgcaaaaagaaacgacaccaccgggatcatccaatttaattgcgacagcaatgattaaaaaaagcggtgataaaataatcaatgccaatgcactaacgcaaaaatcaaatgctcgtttacatgagtgataaatccattttccccgaaccctatctgtatcaattgtcatcgtttagtcctcttagtccaagaatacggctaatctaaatgcgctatcccagttcatattctaccgctaacagcgccgcatgaatgacttggtgcatgtcatagtaccgatactgacccagtcggccaccaaagaccacgttaccttcttgctttgctaattccgtatattgcttgtacaatccattattacgtttattatttactggataataaggttcatcccctcgtttccaatcaactggatactcccgcgtaataaccgtcttgttcttatcacctttaccaaattcaaaatgcttatgctcaataattcgtgtaaacggggtctccgcatctgtataattgaccactgcattaccttgataattgtcaacgctcaactcttcactttcaaaccgcagtgaccgatactccaattctccaagttggtagttaaagtactggtcaatcattccagtgaagatgactcttgggtaatctttaaggtacttttccttgttgtcaaaaaaatcaacacctgtcttcacatcaatctgtggatgatcaagcattttctcaacaatctgtgtatacccaccaattggaatcccttggtaggtatcattgaaataattattatcatacgtgtaccggactggaagacggcgaataataaaggccggtaaatcagtcgctttttgcccccactgtttttctgtgtatccctttaccaacttttggtaaatatccgtcccgactaacgatattgcttgttcttccaagtttttaggttgatcggtaattttagccgctgatttttgctctgcaatcttattcatcgcttcttgtggtgtcttagttccccacaattcattgaacgtattcatattaaagggcaaattgtacattttacccttataatttgcgactggactattcgtatagcgattaaacgtcgcaaattgattcacatagtcccaaatctgtttatctgacgtatgaaaaatatgggcaccatactggtgtacctgaatgccatcaacttcatgcgtatatatatttcctgcgatatggtcgcgcttttcaataactttaattttcttaccacgtagagccgcctcatgcgcaaaaactgctccgaacaggccagcacctactactaagtaatcatatgctttcaaaagtatcctcctccactattaacccttgatttatatagtgctcagcttacgaagaaaaaataagccactgcactaaaaaagtttatcaccaataccaagcccccctatactaaaattttaaaaagcatcattttaatacgcttatgatatagttacgttcttattataaaaatggagagggcggggccttgatctaggggtattaaaaaattttatttaattcatactctattctactaatcaattctttcgtataatatccttcacgcaatctatgttgttgtatgcggatattatcctgtaattgctcatattgagattttgagatggctataatagtactatcaagttcttccaaaatgcctaatgtcaacccacagttgttattctttaaccatgtgccaacattagaattggtgtctgctataggaataattcctgaagctaaataaagacttaacttatattgccaattatatttttcatacgttttaaatgttgtattaccggtcccatctgaatcccataacaacccataaccagtgtttagctttgaaataagtgtttcattatcaaattgccccatatattcaagattttttggaagagtaaaatctaagttactgccaaagatgtgcatatatacatcattgatatttcctaaaaatccagccttagtaaaggaaatattaccagcataattgacagtatgtgaaaaagtaggataatttattggtgtattagtcagaaaatcaaatggatccttttgaataactacaggcaccttcaatccagcattggtcagtacctctcttgctaatttactaggaagagttatgacatcaaattgatttaataattctatatccttttctaaagtattatctagcccccttagactgtttatgtcatgtactatggctataacagcgcactgtttcatgtgtgcttttcttattaagtcgatttgaaaatcagatgtaatataaagcggatactgaaaataaattacagaatttggttctacagcatctattaccttattgttaatatcaggaaactccgttaattgagaattgtacataggataattaattttctcaaataataatttagatgtcagaatatcactgatatcacgacgtggttttattgaaccatcatataaattgcgtaattttggtgttaaaatatacttttccataaatattcctcctacattattgaagtcgaaagagtggattgaagtcaatatttgagacaggttttaagagacattcagaaccgcgtttaccttccacagctcaaataaatcattaatcgcgattaataacttatttgaaccatggaaagcattaaatcaggcggccatttggctcgtaagtgttgcaatttcaacttgtaaggaggtctggtagcccagtgaactatgaattctcttcctattgtagaaagcatgcacatattcaaaaaggacggcagcggcagtttcataatcttcaaagaccggcactggataaacacattcctttttgagggaagcgtgaaaggattccattggcgcattatcatacggacaacccttacggctgtatgagtggcggatatgtagctcagttaaacgttgattgtaatcatcgctggtataccgtgatcctaaatccgtatggataatcaggtccccagtaatggttcgatttttaaccgtgctttcaagggtctttaagactaaatcagtagccatcttttttgagaacgaatagccgataatccgtcgtgagtgcaggtccatgatggttgataagtaacaccagccattacgcttcgtttgaatataggtcatatcagcggtccatttttgatttaaaccagtggtcgagaaatcctgcttaagcaagttgggacgctgttcaaccttggttttggaagccgaagccgctttccacttattgacggtaacggagtggatatccagttccttcatgagccgggaaatccgtcttgggctgcaccgacgctgcagtggttgaagttccagattcaattcatggtggatcttcataacgccgtatcgctgcttgaattccgcaaagatccgcagaatccgttgttttaagtccgcatcttcggcccggcgttttgaaggctttggggatcgataacgataatactgagctctggaaacaccgaggattcggcacatcttagttacctggtggttatggctttcttggtgaatgtaatcaaaaatattggttacttctgcgcaaggaagcccagggctttttttaggatttcgttctcctcagacagggaagccagccgcttttccatcgctttaatttcgtctggcgatttaccggattgagttttggcttggccctggatccacttatgaacggttgaatagccaatgccatattctctggccagttgggcggctgattcgccttgtttatataggttgatgatgttttgtttgaattctttgtcgtaacgagttggcatgtaaaaattccttccttttgagagacgatttattcattatacgctctcttaaaagttgtctcaggaatcagcttacatccagtataggttagtaattaaatttgcaatctaccatatttatatctgtaaaaacagtttttaactgctaggtcataatgtatagataaatcaaagcaagcacctatgtacaaaagtgcctgctttgattaattattaaaaaaattccaatctatatttataaagggttatctccccaatttaaatattgattaactgatcttcaattgctcaattatttacgttctaagaagcctaatacagataaatttggctaattatccatgtaatttttgttgcaatgtatcaccaatgccatctactttcttagcagccaagacggtgccaccgatgaggacaccacctacaatgagcgtagaagcgatcataaacttaaatacacttttcaagatgtccataaaattccccttactttttactggttcgaccaacaactaatgaaacaatcagaactaaaataattgccccgatgatcgatggtatcaatgccatgccagctaacgaagggccccaagtgccaaggagcccttggccaatccacgcaccgattaaaccagctacgatgtttgcaatccagcccatagcagcaccacggttagtgattgcaccagcaatggcaccaatgattgccccgacgattaatgaccaaataagtcccatatttactcactcccttagttaacacgactagatttattgtcagacgttactttatcaacgctgtcacctaatgtttccttcgatttctttgcgcccttactgacggcttccttcgttttgtctgtggcatcgctcacgcgatcttgcagagaagtcgaatctttttcatattgctcccttgtcttgacatcaacaacattcacatttacctcaattacttctaattcggtcatattctttacttcccgaacgataacatttttgatcttgtcatacagtttagagatatcaatgccgtattcagcaacaatgtcgagatccactgcaacctgcttttttccaacctctacatcaattcctgatgtgacatctgaagtattaactagtttttcagcaacatttgagaaaaagccaccatctacggttaataagccatctacttcagaaagtgcgataccaatgatcttttgaataaccttatcatcaaatgttaaattgcctttaacaccagacttttcgttagttgttgttttctcacttggcgttccattctgcataatttttcctccttataattcaaacagttatttaaaaacatttgttaagataccagttttttgaatataataacccgcggtaatcccgattgccataaaaatcaaaacaaaaagcgtcttgaaaaatccaaaagtgatgataaggaccgctaagagcaatcccataattccaccaattagtggccaaaaataggctttaatgagttcggtcacgttatcacctcctagacaactcgagatttatgcacattagcgtccaactcattaaaatcaacgagtctgattttaatttttttctgttcagaaattccaagacaaatacgcaaatctttttttaattgattaagaaaatttgcggtctgtttcttggcattgactgaatttagtagatcacccgatattttaagtgtgatcccttttcgtgataacttagatgataccttggggttgccaataaagggttcatgttgaagtgctgaaagcgcaaaatgttcaatagctttcttactgacggtcacttgaccatcagacttttgatgaagatataatgattgtgaccgtggccaaaaaagtgtgataagcaaaaaaataattaacagtaccgccagaattactccactccaaaagaggtatatcggttcgtaatgctccaaccaaccaagctttaatgacatgggtgtactagtaccaatggccgttgaccaatttttaaagacaagaactatggataaaggaaatgcaaggataataacaactactattaatgccttaaatataaatcgcaaatcatcaccacctttaccatagttatagcacaacaggtagtgatgatggaattatatgctcttataaggaaccaattaagatttttgtttgactaaaccaatctagccaatagggtatatggtactgaaagaccgattagagtattctttgcgcaacaactgggttgatagtaaaggacacgtctactttatctttaccaatcaagaattaatggacttgttcaattgttcaaagggaaaagtcatcaaaataaaagcagagctggaatcaatcggattacttcaggaatcgatgtacaagaatttcttgtgacaccagtgaaaagaaaaaccttcaaagaaggcgtggaaaaagtcgccaatgtctatcatacattgaaaaaaatattggcagaaaaaggccttgaaacagccgtcggtgatgaagggggcttcgcaccaaaacttggtagtaccgaagcagcaatcgaaacgatcatccaagcaatcactaaagcaggatatgaaccaggggcagaaatagcgattgcccttgatccggcatcaagtgaattttatgataatgaggcccaaaaatacaattttgaaggccaatctttatctgcggaagaattactaaactactatcaagagcttgtcaaaaaatatccacaagttatttcgatcgaagatggatttagtgaacatgactgggatggcttcaaaatgcaaacagaggcaatgggcaatgaaatccaattagtcggcgatgatatttttgtgaccaaccaagaaatttttgaaaaagggatcaaagaagggatcgctaattcgatcttgatcaaattaaaccaaatcgcgacagtctcagaatcgatcgaaacgatcaaactagctcgggccaatggctatacgacgatggtttctcaccgctctggtgaaactggcgatacctttatcgcagattttgcggtagcgatgaatgctggtcaaatcaagactggatcgatggctagaagtgaacgagtagaaaaatacaatcaatttatccggatcgaagaagaactagctggttatgcaaaattaactagatttcccgcagctcgccatctccattactgagtttcaaagtgatgtaataagctccagaacacttgttatatcaacgttttaagctaactggctaaaagttctagttcgattgttccggtacaagccgtaacaaatctcgtaacaattttgatgctgacgggctgtatgtaaaagctatcttaaacggatggcttttttatttgaataaacgtcacaataggatccgttgaccgataagcggttaccgttacctaataattgggtggcggttacttttttagcatccaaatcaaaaacgccatacttttcagtatgacgcttattttcattctacgttgattagagataagtagtacatccattacacaatccatgccaacataagaaaccacagttattaatccttataaggaaatatcggtaattctatgtctagatgcttaaaagttttttccatttttttctcactaatttcgcttaaattaccgtggggacttctaaaccaatgatgtgaattaatgtccttaaacgtcatagctgtgctttgtcgtgtcccacccattgctgaaccactattagcaatttttacactagttttcccaggtcttaacgtatcgatgtatattgttgcactaggttcaattgtcatttctgaaaaaatatctgatgatttattattagttgataaaatatatacgtcatatactggaacccttgaagaattctgtataataactgttcttgttgacgacccattatctgctttcgactcaggttgtaaccagcaagctacttgggaggcttgctcactttccttttcctcattattttcttttatttgttttgcattttcgcttgcttgcgtttgcgctatttgtatgctcttattcgtattttgatttgtaaccataaacgatatgattgctagaaccaaacctattattgaaacagcatttcccacgtttatcttatgaaaaaagctttttatttttcccatatttccatcccctactcttataattatatacttagtcaaattaataacacaatcagatttgaagataacctatcgtgaatttaaccgatgcttatccaactacctacaaacattaatacttgttggctttatgtgaagtcatccccaaacagactgtttacatatttaattgagtttactgtttcaaaatgatactaactgccggactagacaatttataaaacatctagcacgagcggcaccgtctcaatttgatagtgtaatcctgtttaattcagttttaactaacctgattgtactaacatttttcaaaacagtaactattatactctgatctataataaccaaaatgagtagtattactcaggcaatatagttctaaacaacctagtcattttgacaaattacatagcacttttgtttagtggttattagcatatagcactagctacaataagcttactttatgttaatccgctaacccaagattgtcattaacttgacactaaaaccaataatcaaacagaaaaaatcatcctcggtaaatttcaatatttcatccataacgacattgaatagtgtcttacttttaaatttctaccaacgataattgcaatatattacctacttgcttgtatgcttccataccaagcaatttctagttcattaagacatgtttacacgcatttattttactttctaggcactactttattaatgataaaatcagccactacgggggtataatgtgcagcccctccccccccctttaaaaataaataactaatttccagagtcgagtcctacccaccggttcctagtttgaaaatttttgtttatttttggtaccccgggggtatagaaaaacggatgctatcaatagcacccgcttcaataataattcactcgcctagtttctcactggtttatagtctgctggcaacgtgatcaaatccattcctttatcataccaacggctaacggtacgtggcgacatgtacagctctgctccaatatctttcaatgatgcatcatcaataaaccttagctctaagactgcggatgcttggggttccagtaggttatcaatacaatttagaatctcgctcttaatcggctgtgcttccgcccgcaatgattgaacccgcatcattagttcatcatacctagccatatcatcatctaacgaataacgccgggttcctcgtggcattccgttgagctgtggactatggacaccttccatacgcttctctaattcgttgagtcgctcgcctagtcgtttaatctgtctggcataaggtaaataccgtaccataaacccccgttttacttgatccatttaagcactctctccataccaattaaaagaagccacccattgcagatagctccatagtggttatttcaccgctgacttttcgaccgtgaatacaaccgggacccaatggggatgcttatactcccggttagtcttagccactggcatacttggtaccacaccatcaattaaataaatcattggtgaactggcctgcatagtcacgcccggccgtgtaaccacgttatcaaatatctttaatgcatccgctgaccaatcaaaccagaatgacaagtttctttgaccttgtaccccaatttctaggctaccatgataatcataattacactggtcaaacagtctttctaactcaacaaagcttgttgcgtcatggctacggatgtagttgtacatctcttcttcaatttgtttagggttcattatcgttattcctttcgatttacggcacacagcggaacacatccggaacactaaaatattgcctgtccgtcttactctcccaagggttttagtgcttggaacacctggaacacatcatttcaaccttttatagtcctataccgtaccctctatacctatatacataataaaaataataaatataatataatagagggatagtgttccagttccttataagtccttttataccagggctttaggggtggaccacatcacaaaaaatagtgttccttagtgtacccgtttataaccacgtctctttgttccgttaattcggggttgtgccggtttccagccttttttgttgtccatcacatacttaattttgttggaaagctttcgatttttaaccaaatctggaacacccatcttaaaagcaatttcagcactggcaacaaaatcaccttttatctggtctaaagcttcctctatttgggcttcctcttcatcaatgtacataaagttctcacgattgcgagccagcattaatgcttgttcgttggtcagcttaaaactaaagccatcccggtaataactaacgaactcaccccataactgatcaatggtttcttgtggtaattcgtccactggtgacttttcctgctgatcaggattaaccataattggtaagaaacggcgttccccggtcttatcctttaaataggttagctcgttggtcgttcgagccaacacaaaatttttatactctctaacatagttacgcctataggctgggcgaaactccaatttttccaaactggcaaacttcttcaatatttcaaaactactgtgagccgttgccgtcatttcatcatcatttacgattagtgctcgcatcatattgccaaaatcatctttgttttcaaaactggtaaactggtcagtgtaccatccattagccatattttttagtaacgtggttttacccgtaccttgtccgccaactaggtctaaaacaaaatcaaacttagtttctggtttaaacgtcttagccactgcaccaacaaaaaataacatagtttgcagagtggtaacttccgaatggtcagcacctaagtaggttggcagaaaatccgctaccctttttttaccatcccactttttaaagcagttgttgaaatactcaattaccggattaaacacgttcttgcgtgaaacgttagtcactgcatcattaatcaacttaggggcaaatactacccgataatgtgcttccatatatgcttgaatggctggtgtgtactcatccttcaattgaccgtgttcaatcaataattctcgtgaatctctagttacttccgtttcgtgcgtgaactcattaaacgcaaaaagttgttttaaaaccggatcatgttctaaaatcaaactagcattaaaaatactattcgctttaatattgccttgcgttgttttcataaagttaagtttctgtttcaacgggactactttctgttgttcctgtaacttaattaatttgtctgcctcttcctctgcactcacagggcgacaccctctttctttaaagtttgcttcccgcatattttgaagttaaccggtcgttctctttataacaatccgttaacatccgctgacttactgtaatcaatgtcaataattgcttacgaacatgtaaggcttcaatggccactgcattaatattcgtgtcggatgcatcccggtcatattggttcaccaaatccgcaaaattttcggcaaggtcttgggcggtgtctagcaattgtacggcgtcataaactaccccattgttctcttcaaaatcgtatggaaagttattattatcagttttagtcattgcctattttctccttttaaaatcagtgataaactaaaacctgtctaggggttctagttcttagtccttgcgtgcgtccacacgttaagggcttttttgtttgcttaaattcacggattgaatattgcttcaattgcatcagacgattgtttattcgtggctacggcgtctgctactgctttgtaattacggttaactaagtaatcgcaatccattaataacaagctgtaatcgctcaacaagcccgccatttcgtccgtggtcagccgttgcattggatcatacttagtccggttctttagttggtcgctgaccttttcaaaatcagtcttagtgaaacttaaatctaaaccgctttgccataatttcatttgtgaaccggccagcgctaacatttcatcattggtcattactaacgctactttatccatccgtgaaacctccttttattaatcgccttgcccgccagcatggatttatttaatttgtccgttgtgattaataaacttgtcgatgtcctccactgcatacagggtcacgccctcaataatgtggcatggtaacccctgtttagtccattcgttgaacgttccagcgctaacgccagcatacttactagccacgttcttgcgtagccatttcatattgataccagcatctcgcttaacattcgccaccgtatcagaaaccaatgtataaacgtagtcccgtaacgcttggtcttgttcatctggtaagatcacttgaattttattcattgcagtacctccttcaaagtaatatttctacagtctgcaaagtcttaattagaaatctttactttaaggctattaattgcctcttccactctcttttttctttcatccgtcagcggagttcttaaccaaacagataatctcccatcgcttataccgatttggttcgcaacttcccagtgaagtaatcgataatgtttcattttttctctaatatccttattactcataatttttcactccttatgtttttatagaatacaaatgttggaacaatgaacactactagctcacaaaaatgattataactgctgtcctatataaaagcaacaacaacgcttgatgttctctataaaaacatatatgatatggagtatacgaggaggaaaccacatgcattcaagaattcctaaattaatggcagatcataagatgtccgtttatgaactaagcaaaattactggtttatctcggactactattactccattagcaaattcagaagatgtttcaccaaagactagaattgaaaccctgcaaaaaatagcacaagcatttaacactagtgtcttacgcctaatttatgacgatttaaaaattcaattagtttcagaccttgagttagatgacggggataaatctaccgttaatccaattctatttaagctaaagtatgaaagtgaaaccaaaatcggccatttcatcattttggggcatactacacccgcttctttttctggtattccatcaaataaaggcgctgaaaattatcccgatatttttgccagtcttatggtcggaacgatgcaatcaagattattcttatcgcttagcttaactagttccgcagagttactaaacacgtatgtacccacttatgaaaaagcaaaggatttcattcaatccgatgatttactcaacagtgacgatgatttcgtttctacatttacaacgaatgagattgagaataccatccatacaattgttaccggttatgagatgcaacataaaactaccttctctcaagtaatttgggatacacaggttcgtgcaattccaatcattgacgataacaataaagaacgcatcattttcagcaacaccgcaaacgaaggaaaaccaatttatcatgatttaaattaatcccccctctacataccaacgcccgccagcatggtatgaaaggataatagcttatggctaacattaagcagtacactaaaacggatggtacatccgcttggaaattcaatgtttatttgggtgttgacccattgactggtaaggaaacccgcaccaatcgtcaaggcttccacacgaaaaaagaagcccagctcgaactagccagacttcaaattgagtttgataaacacggtaagaagacgcacgttaaccgcacctacgaggacgtttacagtgcttggatagatgagtaccgcaatacggtcaaggaaagcacctacgttaaaacagttggctattttaagcaccatattttaccggcattcggtgcttaccggattgataaaatcaccgtggactattgccaaaagattgttaataactggttcaaagtattcaaaaaataccagtcagtcatgaactatgcatcactagtgttcaagtatgccgttaaacatggcatgattgaccgaaacccggttgacttgattacgtaccctcgccgtgaagctgttatcggtgcgaatgaacatgaaaacttctacgctaaaaaagaattgcggatgttccttagtgctcttgatcaagaagatgccgaacacggaaattacaaggctgataccctattccgggtgctggcgttcactggaatacgtaaaggggaggcgctcgccctaacgtgggatgatattgattttcagcagcgtaccatcacaatcaataagggattaacacgaggcgaacacgctcgcttgtacgtccagacgcctaaaacgaaaaactctaaccgcattatcgatatagacgacaacacaattagagtttttaagcagtggcaaatccgccagcgccaagaattattcatgtttggttataacgtcaacgacaacgaacaaccgcaattaattttctgtaacaacaagaatgagtatctttctccgtcacggctcagaacatggctcgtccatattattaagaagtatcacttaaaatatatcacagtccatggattccgccacacgcacgcttcaattctctttgaggcgggtgcatcattgaaacaggttcaggaacgactaggccactccgacattaaaacgactatgaacgtgtatgctcacgtctcaaagcacgctaaaaaagataccgttgataagtttatgaaataccttgatttatgataacccgtaacaaatctcgtaacaaacaacacataattagccagcaacaaggcttaatatgttgatataataacatccgtcagtataggggttcgataaagtagcaataccctcacacagcaacaagcctattctagatatatacctatggcaattgatagcagcacttttcaccccgttcctctcctcgtctccattacccacggtggtgctgaatcaccactcaccgcttgcatctcagttgaagtgagaactgttggctcataactatttgtgcttacagttggcattagtgtcgttaaataccccgtccacgcttgactttgagcctgacgtctcaccatagccgacttaaataacatggtcaccgtcgtcaataaagtcggctggttaccacgcttcacccgcttcaattgcgaagttgcttgtaattgcttcataacccgattcaaactcgccggagaaatccctaactcagcctgaatttgacgcgttgacatggcaaccgaagcagcagaaccacccattcgattaatcaacgcaagcacatcgttacgccattcattagcatggctgtattgtcgttcggcacgtggcttagcaaatttatgccagccaatccccacaacgactttacctgagaaattaggcacccattgatccaatagtccttgaacataactcagtgcggccccccgatagtcacctgaataagcgtctctgacgcactgtacaacttcgcgatcgaccaatgggtcatgtaaatttgaattaaagacgtcaagcacgtctctcgcacgctgctgagaaattttagattggtacatcgctaaagctagtgtcataacggtgttatgacgggctaatccatggcctgatttgactgtcgtcactttcaataacgctttaaaccaagcttgatcaacctgacggccctcatcagaagacaatgaaatcacctgatctcccatttggtccgtgacgggaacttgagcagcataatactgtgaccacttcatcagagcgctcacctggatcaacatattagcatcaaaaaaaatcagattatcctgacgcggaattcggaaaatgccaaaattattgcagcccacatcgaccccagtaacccgttgttgaatccactgccgcacaaaactagacattttctgggccgctttcaaaactggaaactggccgcgcttcttccgtaaaaacataggctgatcaaaaacgtagtagatatggaaccccttcgcagtccgcaaaatcatcgtgggaatgaataagtcggcaaccgtgaccgcacccaaaacttcccgctcccgagcatcgcgttcttgcgcgtcagcaaaatcaatatcaacgaccaaggtattaatctgagctaagttagcttctcggtgaccacgaacgctccccctgttctgcgtgtagcccagccagttaaaggtgttaggtgtccagtgagtcatccgatcagcaatggcctccaggccttcaaaagaggtgataaccacaccatgggctttttgcatggaatccttactgctgaagagcgcaatggcccctttctttgtaggggtctccatcacttgtccggcaatattaaaactactatttttaactttatatgtatgtagtgaatcgtgtaataccagtctttgtgcagcctgaaccgtctttaaatcgtacatggtgagctcacctcctttcaaaataaacacctaagttagcttaatagaaaatacatagaaaatgaaaaagcgcagacaaaaaagcaacttagcattatgccaagttgcttaaggtgaaagtagtccgcctacccccgaataaactttaaaattaccgcctacggatctaagtgaatagatccagtgaatttgcacagaagtcgctcaccacacgtgtccccttagtctttacccggcagcttgtcccctaccgttttgaaatcacaccattctcgacatcttaccaatttgctggtataatcttcatagttgaaaaagatttttttcgagtgctgaccaattcccgttggttggcgcttttcttatttataagagaagtgtacctcattatctcttcaaaataaagaggtttcttttttatatttataaattcatacatacatgaatttataaataaatgaattcatgtatgtatgattgaactaattgcctttttaaagcagttattgtcaatagcaataggaaccttgacacaaacaacaattcaagttatacttattttgttataaattcatacatttatgaaagtgtggtgcttagaaattgaaaaaaataaatttaaaaagacccctcacaattactgttgcaaatcaaaaaggtggcgccggtaagagcacaatcactcgttacttagcctacagcctgtctctccacggctatcatgtgctagtcgtagatgaagatccacaatccaatactacaaaatcattcgtagtaacaaaagaacataacgaaccagattcagtttttgtcttagacaaaacaatgatggccggaatccgagaccatgatctaactgatttagtcgtcaacatactcccaaatttagatcttattccggcccattatgatttaaagaatctaacaaattatcttagcaaacagtatggtgtcgccgaagaaggggacgccaattaccacgaagttaaatcgaaaaagctcttctttttaagagaattacttgaacctctcaaaagccgtggaacctatgacttcattttcattgacacaccaccaacctcttctgattatactgactccgctgtaggagcgagtgattacgtccttgtcgcctttcaaactcaatcagattctctggacggggctcacaacttcattttcaatccagacgagctaccagagaaggtaaacgagttcggcgtgccaaccgatgtactcggtattctaccgaatcaaatgcagcgatccggaagtattgacgaaactgtaatgcaagatgccgtgaacttctttggaaaagaaaatatgtttaagacaattgttccttacaagcgccgtctacaatccgcaccacgaaacggtctacgaaatgatagttactgggacaaagatatttttacttcattcttagataatctgacgaatgaattcattgaacgcgtgaacttaatggagagtgacaaatgatgactgaatcaagacaaaaaaaacccggctttttcacaaaagataattctgaaaaagatacattaaaaaaaggatcaggattactcgataagtcatacaaacctgatccgcagccaaaaaccctatatcgacctgaaccaactatagaaaccaataatagctctaggtccactcaaggattcggtaataagagtgaacgaaaatctttagttttgccggctgaacaatattatcagtttatggcactacttgatcaatcagcatttagttacacctatgagttacttggagatcaaatgcagccacaaattgataaaatgagtcaggtcgaacgacagatgtttgatatgaaggtagcccaactacgtgagaaagatgaaaagaagaaaagaactcgaaaaaaatcataagtttatacaagtatgaatttataattgtataactagatttgataccactagttactatcttcactatgcttcttgattacgagcgtcatagactctctatcccgtgttgtaacattcatatttgtatactttcataaattcatatttacatacaagtatgaattttcaaaagtcagtcgttaaaaattacgtctcttcaatcttcacactttaacatcaataacgcttactcgaacaatagcatcattgatagctaccaggctatcaatgatgctattgttcgtcatattcaaattgctgtagatcaacaccaccttaattactcgaagcttgcagcgtcttggaaaagagagaactccactataaaaagcgaaagtgttctcagaatgcgcctatttaacatctaatttaaaaatgtgctcttctacttgttgaaaagtatgctgaaattacgtgaggcgctgcaattaatgcgtagtagattaaaaaatctacactgctatctttaattaccaatataataagtaacatcgcagtagataagacgacaagtgtggtacgtaaccacggtactgttgtcacatgattgttttctttgaaacacggattcctacgctcaaaaagttttaatagcgtactaaaaattattaaaacgacggtcgcataaatcattattattaaccatgaatgaataatctcgatcggaaacaaaataaaagcaatgattaggtattgaaaaagcgtgtagtttccataattaatatcaatcatctcgtttatctccctttcaattttaactacaattagatattggcaaatgtttaatgttcgatattcagttaaaatcaacgaatcccggttaaccttttattcgagaacttcttcattcaaccgattcttgatattaatgacagtctgaaccgagacgccggtttcagccgcaatcgcacgatagcttattttagctccggttgctttgtttcttaactgctcaacgattcgatgataaataaaccgtttctgcggattaggcgagtcctcggcgtataccggccgagttccgcggtatttcccattaaccttagcaatttcaattccttgacgctggcgctcacgaattttcttccgctccgtctgggccatataagctagcagcttggttagcatatcgaacataaatttgtccatatctgaatcaccagtttgcattgaaagaaacggggcatctaagacttccattttaacctgtttatctctaatctgtttgattatatcactggcatcgtcatagtttcgactaagccgatccaatgaggccaccactaatgtatctccttgccgcacataagcaatcgccgcctgtaattctggtcggttctgggtcgatttgcccgattgtttttcttcaaagattttctcacatctggccactttcaaggcttcaatttggcggaccaaattttgatcagttgaactaactcgcgcataaccaactttcatcaataactctcctttcagaggatcagtctcccccaccctactgcattctgtttagacactctaattagacagtttgacaaaaacaaagaactgcttgttatcccaagcagaatctaagcttttcttcataagttgattatactgctttttgtccatttagggtacactctattgtctcttgactctgttactaaattaagttttgggcttgtcgtggatttcaatgtttcaatatttttcggattaattttacaatctaccatgtttgctttaatatttctattctggctagcaaaacgatgtggtaaaataactaaaacacaggagaataagctgtgcttagaaaggtactgaattgagtgaggagtgtggggaattggaaaaggcaatgttatcggtaaaaaatcttaataaatcatttgggcgtaaacaggttttacaccaaatttcattctcgtgcgaacctggacgaattgcaggtctcgtaggagcaaacggggccggtaaaacaacaattatgaaagctgtactgagcttaacatcagcaacaggtgagattactatagatggtcggagaagtacgtttgatcatcacgatgcgttggatgaagtaggtgctctaattgagtatccaagcatctatccctttatgactggacgagatcatcttaaactgtttgtgattggtaaaaataagacatcagaaattgacgatattgtcgaagctttgaatatggaaaattatattgacgcaaaagcgcggagttattcactaggcatgaaacaaaagctcggtgttgccgtagcattcttgaacaatcctaaatttgtaattctggacgaaccaatgaatggtttggacccacaagcgactaaagaactacgtgagttgattattactaaacgtaatgaaggcgtaagtttcttgatttccagtcatattttaagtgaattacaaaaattggccgaggatctaatcattattgatcacgggaaaatcgttcaagagacaacaatggatgcactgctcagatctaacaaccatttcgtcattttaacgacaacgaatgatgtaaaggcaaaaaaggtgctatttgacgctggatataaattggttgaaagcgatggagtaaaaattaaaacgtcatctgatgacgatgtagctaatattttgaaaacattgagtgatagtcaagttcccgttaccgatgtccagcatgaagatgaagatcttgaaggttcagtattaaaattactcaatctagaagaccggaaataggaggagaaagcatgttgacattatatcgacaagagtcatttaaacttttaaagaaaaaaagtaccctttggatcagtattttactagctgtagttacatttggtgtcgcattattaggacgcttaaaaccaactatttttccggcaaaacaattttttcaattaaactttatatcagcaccatttctagtactttttatgattgcggctactgcctcaatcatcaccatggaaacacagtatggtacgattaagaatgtattatcacaacgttattcacgaacccaagtattgattagtaaatggcttgtcatgctaacatactccgtctatttatatgtgatgactagtgtattagcactgattggtaaatttatttttgtcaacaataagttttctttgactgataaaggagacgttcatcaaatttggctagattggttaataactcttagttcaaactttctaactgtttggttgctccttagtctggttttcctaatggcgaccttgtttaagagttccgctgctgctatttcaattggaatcattggttactttgcattgagtcttcttaatgggttcttggttgtgttgattaacctatatgaatgggtaaagtggaatccactaaactttttgaattatccagctcaactcaacaatcctgcacttagccaaatcacaaagttgtcaactactcaattgttttggggaaatgtttgctatattatattatttttgctgattgactggttaatctttcggaaacgtaacgtatagatgaaaaaacaaaaaaaggccctcctaaacactgtgtaggaagggccttttttaaatgttatttcttctctgatatggcaaattacaaatttaatccgcattttaacggtaatacttacaatacggtgtctcctaagaaagagagccacaaccgttaagttgtggcctcttttttgatactgtataattaaagggttagaaccgtgtcattacttaatgacataagtaaggagataaaaagatgaaatatggctatgcgcgggtcagtaccactgatcaaaaattagcaaatcaaattgagttactgaaattggcaggagcagaaaaaatctttcaagaaaagtttaccggcacaactactgaacgaccggagtttcaaaaattgttgcgcgttctaaaaacaggcgatactttgattgttactaagttggatcggtttgcacggaacacgcgcgaggcattagccattatccaagagttgtttaaagaaaatgtcaaagtcaacattttgaatatgggcttaattgacaatacgccgactggccaattagtctttacaatatttagcgcctttgcgcagtttgaacgcgatatgattgtcacgcgcacacaagaaggtaaattgtatgccaagcaacatgatccgttgtttcgggaagggcgaccgaaaacgtattctgaaggtctcggctttaattttctcaaaaagttatcagtttgaacagagataaattcagatggtctcggtctaaaaaattttttagtaagaagtttgattttcacgatttttattctcctaattgactaaatcttatcatgttttagactccgacaaacaaaaaaaccatcataaggtagattgtaaaattaatccgaacgctgttcagacaaaaaaaccagcttcccttaaaatggtgtttaccacaaacccattttttaggagctgatcttttgtctagtataacctattctgaacgaattaaaattgaaaccttttgtgaactaggactggccaatgcccaaatggctgagcagttaaaacgatcgccgtccacgatttcttatgaattatcccgctgtcaaccttatcaagctgagttggcgcaagcgaacgctgaatctaagcgggcacgatgtggtcggaaaactaaattgaatgccaaattaaagcaaatcattctaaaccatttacgtctaagctggtcaccagaagtgattgctcatgatcttaaactagctactaaatctatttacaattggctatatcaggggaaatttgaattttctttgagtgacctacctgaacatggtctacgccaacggcgtaaccttgaccaacgttctaaatataatcaatcattaggacgttcaattgaccaacgaccaattatgattaaccaacgtaaccgcatcggtgatttcgaaatagatacggtggttgaccctcgcgggcatagtaaggccgttttattaactttacttgatcgtaaatcacgttttctttgggcgtatcaattaaaagatcggacagcagcagctgttaatgaagccctaatgaagttcctagcaacttttaaggggccagtacacagctttactgtcaatcgcggtactgagtttagcaatctagtgtcatttgaatcacaatacggtattccaacctattactgccatgcttacacaccagctgaacgcggcagtaatgaacgatttaatcggaacttacgttatttttaccctaaggggacttgttttgagcacattagtgctcaaaatttaacaacgacgttacttcaaattaaccagagaccccttaaagtactcaactggccaacaccttaccaggtaatgttgactaatttgtcagaaaattcggattaaatttgtaatctaccacattatcagtgtatcaccagaatgataataatgttaactaaatagtaggctcccagttaacttctagtgaactgggagcctactatttagtttctatctaatcataatcttcgtcaatttttttaattcctagcccaattcgtttgataacatctgtaactagtgcattccccataaagaacatacgcatacgattgcttactttctttttttctccattaactagtttaatcttagtccagtcatcaggaaaagcttgcatcctctcagcttcaataggtgttaaaaggcgataccgaccattaattctcaaaaaatgtgttgaccggtttactgatccctcagatgttagcattgttctgcccggtagttttaagtcatcatagggtgacatgcctccttcactaaagacatatgtgtgtcctgtcgaactagtcctttcaattttctttgcccctcgcaaatatttaaacttattaattttattctgatctgtgacatagtaatcttcatttacttcagattcaggctgtaatatgtccctcaatggagttggttcttcatttcctaaagccttagtatcaactgtaaagaattttccgtgatgcataataccactgttgaaaacgttacccttgaagttgtccgaagtatctacaacatcttctggaaaaacatatgatgcaatgcgtcccttatagggcatgtttttgacaggaaattgtttcccaaataagccctctttcattacataactataatatgcgtcatgttcagatgggtcctttatttcaccatatttcttgtccaaatgcttggcgtaggctaaatcatttctaaatacaaaaatatacacccgacggcggcgttgagggccgccataatctgcagcatttataacacgccattctagtgaatatcccagcttattcaaggcagaaagcataattgagaagtccctcccacgttgcttagatggtgcttttaataatcgatccacattttcaaatagcatgtattttggcctaatgttctgagcagcacgaatgatttgccaaaataaaacaccctttttcccttgtatacccaattcaccatgcgtagttcttgcgacagagtaatcttgacaaggaaatccaccaacaatcatatctgcgtccatagatttgaatttcttatctgagatatcgttaatatcaattccaatattatctgagtctggaaaatgataattataaacttcaaatgcatcttgactcttgcgagcaggttcatattgattagaccaacatgtctgaaacgtgtttttatcagcatgctctaaaccaatcctaaaacctccaaccccagcaaataattctaatattttaagtggtttacccatttgtattctctcctataatggttaattagtattttccattatataatacaaatataaaaagatcaaataataagggaacaagttttcgatataggagatagtacaatgaaatcagattatagtagtaaagaagaggtacataatagagctttaaaaattaaagacattagacaatccgatttgatcaaacaactaggactgaatattcgaggaaacaaaaatgcaatgggagatgtttttgaagcatggtttggaaaaacaaaggataattctagtgaaccggatttaggtgtatcagaacttaaagcaacaccatttaaaatactaaaaaacaaaaaaaatgggaaatcacaatacagtgctaaagaaagactagtgcttaatatcattaactatatggacctagtcaatgaaaattttgaaagtagccatttcttgaagaaaaataaaaacctagaaattgcttattatgaatataaccccgatatacccaaagatgattggacttttaaatatattatcttgtatcaaatgatgaaatctcccacggattttgcaatcattaaaaatgattggttacttatccaaaaatatgtatttgaaggcagagccgaccaaattagtgaaagtttaactaattatcttgctgcatgtaccaaggggaaaaataataaatcagtacgcgaacaacccttttctgatattccagcaaaacaacgtgctttttcttttaaatcaagctttatgacaacaatgttacgtgataatataattggcaatattagaagcgacgctatcatcaaggattcagttgaactattagataattcacttactgatattattattaaaagatttcgtcctttcattggcgttagccaagctcagctacttaaaaagtttaatattaattcaactgcaaaaagtaaaaacaatatgattaccagagctattcttggcctgacacctaatcacactttagataacatctctgaattcaataaagcatctattattccaaaaacaatccaatttagtcaaagtggaaataatagagaaagtatgtctctgccgccatttaaattcaaagaactagttactcaatcatggtgtgattcatatggattgcctgaagctgatttaaatatttatttacacgaaagtaaatttctttttgtagttttccaaaaaaataaacatggtatcaatatacttaaaggaattaaattttatactatgccactaaaagaaatagacgagcaaataaaatatgcttgggaagacaccaaaaacaaattattagatggcgttaccctttcgtttaatggaaagagggtaactaacaacttaattggggttaaaaataacatgattgttcatattagaccacattctgccaaagctagttacatcaatagtccattttctaacaaattgccgaccaaagctcattggtctaataagccctctgaattttctagttattatatgacaacgcagtctttttggttaaataatgactatataaagaatgtagtttcagatttacttgattaaatgtatagcaataatgttcatccttagtaggagggattgtaatcgtaatctcaaatccatttaattcatcattcttccttttgactgccgaattcgcctcagaaattggtcaaggattgcattaaccgtactggtctaatcttcaccttagatatttaattatttcaagtataagtctgccctgtcttagttcacctactattggattttttgttggtattatagttgtaaatcgcattttagtctttttaccagcatacacggatatcttacctgcttgccgtaacagttagattgtgtggaccctccttcttgaacttagcacttggatttatgagaccaagccggtacagttcggttaaatactaattgtaaaaaaggagaaagtatgaagtaccccctgagttggattaaatccaaagtaaaggggttcaagagcaaaaaagaaataagttaaagcctgacggctataaattaagctttgattttgattatacctaccgcctttcgtttggtagagaaaaatatgaggaggatataaaatggagtatccaatgtacaatcctagcgttcttgatcaatttgtcgaagataccgccgaatactttactgatgatcccagtaatgcaatgtacctgtttccagacggacgcatgaccagtagcaccttatatgggatacaatccgatgaccacaacatcttattatttatcgcatagattagcccacaattgattcggcgtcacaccatacagatttttttcgttctaccaattaattattctcgattgttaaggttttaaagacttctttttcaaacgacggctccaacataataatagtcccttcccttgcttttaagttactcactagattattatacgcgaaccaattggtatttaggattcataatttaatatagccaggacacaataaggttgaaatagataaaccgctaagaagataataatctaatattgagttaaccattaaattcgaaaggtttgttccaataaagttattatgattctcataacataaatttaaaaatacattttgtgatattcttgctggcaatgtgttttattattctattaaaaacataatactcgatattactggcagtgtaatattaccagcagtataattgaagaatgttaaaatattcaaatggatttgtatctataataatgagtggagaataaaattatggtaaagggatttcaaaaaccaattacaatcagagaggcaatagagaacattgaccaaaatgagtatcttcttcccgctattcaaagaaaatttgtctggaagccacaacaaatcgaattactttttgacagtataatgagagaatatccaattaattctttaatgatgtggaaaattacctctgacaaaattaaagaagattataaattctattcatttttaagaacatttacccaacgatatggtgaaatgaatgtagccttaggtacaagaggccgaactagttcattttatgccgtaattgatgggcaacaaagattaaatagtctatacatagggataaagggaacttatgcagaaaaattgccaagaaagcactggacttatagtgaagacaattttcctcctatgaaactatatctagaaattaagaacgtatatacaagtgattctgaaatcgataagcagtacaactttaaatttttgcgaaaaaatcaagtaaaggaatttaataaaaaatctcaattttggtttgaagttggtaaaatattaaccttatcaaagcctagagatcagttcttatacttacaaaaaataggcttaggggataatgaacattcagctattcttttagatagattatcatcggttctcaataaggatacagagttaacctattatgttgaagatgagcaaaatcttgataaagttttagatatttttattcgaacaaacgatggtgggacgaagctaactttttcagacctattaatgtcggtattaaccgcaaattggccagatgcaagagaaaaattcaatagcttaattcaggaagtgtacttgtacggggatttcacaattagttctgatttaattttgaaaacaacattggtcttattctcaaacgatataaagaatcgagttaaaaatttcgataatgatacagtcaacaaaattataaagaactgggattctattagaaaatcaattttaagcacttttaaaatgttctatcgcatgggttttagaaacaagacttttcccgctaaatccgctgcaatcccaattattctttatgtctatgataataaaatgtacaacgatatagaaaaaaataaattttttgaaaacaagtctgtaatttcaaccaaccaaaaaatcaagaagtggctgttactagcttttttgaaacatatttttagtggtcaaactgataatgtcttaaaaagtattagacatattattcgcaaaaccggaaatcaagattttccaattgagaaaataattgatagctccaagaataatccaaccaaaaattattcatttgattccgaatttgttgatggactgttccagactacttatggggacccagacattttcttcattttatcattatactatcctgagttagattattttaatcaagattttcatatggatcatatacatcctaaagacaagtttctcgatgaaaaatatatgaaaagtatcttttctgaagacacagttcaatggattaacgctaactggaattgccttggaaatctagaactattaaatagtgaaaaaaatgaatctaaaaaagataaaactttgaaatcttggtctgaggaaaacaaaattccaaattcatttttctttgtagatgatgatataagtcttagattaaatgactttaaggaattttattcaaacagagtggcaaacatgaaacaaagattatttgatttgttagataataatactagataataaagaagactttagaaaagggttgaaatctggtttaatcttgcttatatccaatggcacataaattaaagacgggaagctaatttttatagcttctctgtcttttgtctgccacattgcgaatttctggtagtgggataaaccgattagcgtcaatcacaatgtcattgacgttgttgtgcatgctttctacaataggaagagaattcatagttcactgggctaccaggacccccttacaagttgaaatcgcaacacttacgagccaaatggccgcctgatttaatgctttccatggttcaaataagttattaatcacgattaatgatttatttgagctgtggaaggtaaacgcggttctgaatgtctcttaaaacctgtctcaaatattgacttcaatccatatcaattaacggaggttttccaatgcataaccaaattgttccagtatctctaaataccaaacaagcatcccatgaccagtctaaagcggctcgtcaagtagcctgtcaattgagaatctatggtcaaacgatcattatttataacggtattcaacagcgtattctggagacggtccttaaaaaggcctttgtggctcatgactaatcggctaattgatttacgccaattaaatcagatttatatcgtctgtggtcggacggatttaagaaaaggaatcgatgggttagcaacattgattcaagaagaatttgatttgagtcctttcaagtcagcgctgtttctgttttgtggcagtcggcgtgaccactttaaaggtctatattgggagggcgacggctttattctattatataagcggtttgaaaacggccatttacaatggccacgtagtcaaagtgaagtccggcaacttagtcagcagcaattaacttggttactggatggcctatcagttgaggcaacaattcatcaggcacgcaccggggccttttattaatatgagtatcgtgtggaaatacccgattacctaggcaaagctagtgtaatcgggtattatttagttataaattttttatagaaaggcggcgtgctggcatgaaaaagaggccccaaacattggacgaagtgttactgattatggaacaacaacaagtgcagattgacttcttaatgaaaaaactgtttgaccgttctagtgaaaagaatgtcattgctcccaatcaaaccagtttatttaatcagtcagcacctcgaccattggcaccactacgtcaggaatcaactccaaaaccatcacgtacgccgaaggcgaaacgggaagcggttttagatgctaagttgccggtagaaaaagaagtctatgactatgcccggcgtaaagtgtaaaatctgtcagcatgagatgacgcctactggtgaacattatgtacgtgaacaagtcaccctaactgagcctaagataattcgcagaaaggtttatcagcaaacttataaatgtgtgcactgtgcagccacggctgaaaagccgggtgctttctataccggtactccggtaccaacgccaccaattgcccacagtttagcatcaccatcgattattgccgaagttattcatcaaaaatatgaattacaagtgccgctggcacgccaattaaaagactgggagcaacgtggcttcaagctttctacagctaccgcgtccaactggatcattagagttgctgaagactggttagccccactggtagcaacgatgcatcaggatttaatggcacagtcacatctacatggtgatgaaacgccgtatcaggtgttgaatgaactaaataaatcgaatactagcagatcatatttgtggctcatttgttcaacggttaatgccaaacatcccatcgtatattttggctatgaaccgcaccgtgatggtgcggctgccaatcgcttatatactaattttaatgggacgttactttgcgacggttacgcggcttataatatgctttcgccaacaattacccatgcaggttgttgggcacatgtgcgacgtaaatttgtcgatgccgctccagttagtacgaccaaaggtcaggctaactacgccatcgatctcattaatcgtttgtttaagcttgagaaacagttcaaagacttaccgggcaagcgacgtttaaagcgacgacagcttgagagtaaaccactagttgataatttctttcaatggatgagtgaactaacctatttaccaagctcatcactggggaaagcgattgactacgcggccaagcagcagccgtacttggtccagtttttgaatgatccagaaatagctttaagtaataacattgccgaacggcatataaaaactgccgtgatgggccgtaaaaactacttgtttagtagtagtcctaaaggggcacgtgcaaatacggtgatgttgagtttaattgaaagtgctaaagctaatggactaaatccacagcgatatatagcctatttacttgaggagatcccccaattgagtcaaccaataaacgcggtcgacttacagggttatttgccatggaccgagcaggttcaggcgaaatgtcaggcatagaacaacgccacttcattcactttacgtgagtgcggcggcgttttcaatacatcatcttattaagtgcttaccaagaactagccaaactttatttatcgaattaaaattgaatttaaaatcaaaatcgaaaaaaagaatccaattcgtaaatgaattggattctaaatataacttcatcaacaccggttgacagagacccagtctttgttactaagaaacagttcaatatcgaacttgtactgaacatagatttaatcagctttcaattgatgaaaataccgcaactgtacaacgaaagaaccactttttacatacttacataccgtcgaagttgtactaccgtgggtagccaaactggatagttcccttctggtaggtaacctaaagaaatactcaagatagtttaatatatgtagtagattgtaaaattaatctaaacacggttcagacaaaatagagcagtttcccctaaaatggtgtttgccacttctgaacaagttaaaatcaaaaccttttgtgaactgggactggccaatatccaagtgactgatcggttaaaatgattgacctccaagattacttatgaattgcctcgctgtcaaccttatcaagttgaggtggcacaggcaaacgctgaatacaagtgagagtgatgtgaccgaaagactaaattgaatgtcaaattaaagcaaatagttttaaaccatttacgtctaagctggttaccagaagtgattgctcatgaacttaaactaaccactaaattcatttataattgattatatcaaggaaaattgaattttccttgagtgaactacctgaatatgaacgacgccaacagcgtaatcttgaccaacgttctaaatataatcaatcattaagacagttaactgagccacgaccagtcgtgactaaccaacgtaaccgcgtgatttcaaagtagatagagtggttggcccttgtgggcatagtaaggccgttttattaactttacttgatcgtaaatcgcgctttctttgggcctaccgaataaaagatagggcaacggtgactgttaataaagacctaatgaagtttctagcaacttttaagtggctagtgcacagttttactgtcgaccgtagcactgaatttagaaatctagtatcatttgaaccacaatatggtattcagatctattactgccatgcttatacgccagctgagcgaggtagtaatgaacgatttaatcggagcttacgttattttaatcctaaagggacttgttttgagcacattagtgctcaagatttaacaacgacgttactcaaaattaactaaagaccacttaaagtacttaactggcaaacatcttaccaggttatgttcactaatttgtcaaaaaattcggattaaatttgcaatctaccaagctttattacatctttaattcgtatcaccagactaattgttgacgaaagatcatttgaaatagaactacgattgaacaatcactaacaaatttcaatcatagtcttcaaccattaggaagtatcgttctctctagttatggtgagtttagcgcctgtctggtcactttcgttaaacgtaaaacatagtaagaattaacggactatcacgcctaaaaaaattatagggtaaaatctatcttcccgctctatttaccatgagcacaggcaacgagtaacactttaatcgtcatttgcgttggttctttctgataaaattcaaaccgccctaggattaattaaatatttctacttttaaatttaattgccagcaaactgttattgaaagcttacgaatttctcgaattgaacttgtactatacatggtcagatcatgggaaaatcagaaaaatattatcaagtagcttgagaagaatttatcctgtttatctgtgataaattctccattatacttcctaattacttcccttattagttcttgtcctaagccaaaatgttgagatgttctaatactatttctattcttatctgtatcaatcaagtttttagttttaacaataaacttttcacgtgtgtaaattattgttatctctatcgacttattacgggttgtgtcagcataataggcaatattatcaaataagtttcctaatattattgacaagtccctacttgaaatcttttcaatatcaggatccaaactcatttgaacattcaaatcgtctattgtcataccaatcttatttaaaaaactacttaactgaatatccacaattctgttaccacttctaacttcaaacatattaggtggctcatatgttaattctttaattaactctaaggcttctaaatattttccttcctcaataaacataaatattgtatttaaatattttctaaaatcatggattagtttccgttgctccttaaacgactctaatctattagtgtatttctgaataagcatagtttcttccatatttttttcattaagacgtcgtactttctcaatgaacttttgaaaataataaactgtaacaaaaaaggtaatatttatgcctaatataaatagtatcgatatatagattaatacttttacccgacttagactgaatattatactcaaaattgtacatgacaataacggtattggaaaaaatagataccaaaataagccaatattatgtacgcgtattgacttaaattgtgaaatcatagtcaagaaaaaaccttgaaataaaaaactaacaattactgcaagattctttaaagttattaaatttgaactcttacaaatttgactgataaatagttccgcaatcaattcagaaattgctgcaacgaaaatacagatcgttgtaccaataattcgattacggaatcccgtcttagtaaccctcataagaaaaaaagtagttataatagaaatggtagcaactaacactattggcattgaaataatcgtactacaactgaaagataatgttgcgacaatcaaagtaggaatatattgatccgaattctttacattaaacagtactttacctaaagcacagaaaattaacacttgcaccagactcgttaagaaggaaaatccgtatagataaatgtcagattgtaaaattaaattcacgcttccctggtaaataaaaaacatgcggttattaatttggcgccaaattattaccgttgaaaggaggatcaaaacgagcaactcccttgtattatttgaactctctacaaggacaatctaaaaaatattgagaattgcctcaatgatatgttgataatcaacttgcatgaatcaattaaagtccgttcaagtttccagaataaaaaacaactcttgagtctttaaggaggactgctcagcatcagtgtatgttgatctgagagtatattagatattcacatcactacaaattcagaatacttgtcaagaaaagcattcttataatgacgagctatatgcaatgattcggcattatccattcttacaagattatgtgaaaaactggtcacatgccttatatttataacagcgaaccggctaatttgaacaaaacaattattttgtaaagcatcacgaaagtggttcaatcgatcatgcactacatactcgcaactattcgtatcaatatataatagccgtttggccgaattcttcaattttatcgagattaaacagtctactgctattatttcatcatcactacttgatatatctcgaatgcacacaaattttttgttttttagattatcactcctatgcttgatttttagcaactcttcagcaactctttccttatctaaaggttttactaagaagttctctggatgagcctcaaatgagtcaaatacaaatctcggataattggtgacaaaaaatagtgtccatttttctgtacattcatcactcacttttgagataaattgaataccatttaaatcaggatttttaaagtcaatgtcgagaaaaataatatcaaaactatcatcagtcttaagaaacaattccaatttttgcaatgagtcaactattttaatattgatatttaaatcatatgcaacatctatgtcaattaacatcttcttaaattgaataatgaataaactatcatcatcacaaattataacgttcatttattcccctcttctataaaagtctaatgtcccttatgattttcacgttttttttgttgcttcttttcatattgaatatacctattagtttgacgcatttttgaattgagctttttctttttttcttttttttcgtcatgttgcatttttatagcattttgagccttagttccaattgtaacctgtttacgtaaagatttttttaccattctttgtagccgtttagggttaatatgagctttcacatctacaacactgatttcactttcagaaaaatccaatgtatcccacttttccagaataaaatgatatatattaacaattttaggatccgaaggtcctacatttaaaacagctacaaaatagtgattgctctcacttctctcaaaaattattttataaaatggcgcttcaaatacaacagttgcacacaatctgtttatcataagaattcctccaaataaagaatacgaaaatatggacaacccggaggaaggttactgacaaatcattatttaataatttgtatttggactaccaaccaaaatagtgtttttaattttctataaatattctaaatcttagcaaactattattcaacgaaatgaactaatcttttgagagtgcaaaccaagccatttcttttgaaataattgcggtaaactataaagagaaatcctgcttaggcaagttgggacgctgttcaaccttggttttggaagccgaagccgctttccatttattgacggtaacggagtggatatccagttccttcatgagccgggaaatccgtcgtggactgcaccgaagctgcagtggttgaagttccagattcaattcatggtggatcttcataacgccgtatcgctgcttgaattccgcaaagatccgcagaatccgttgttttaagtccgcatctttggcccggcgttttgaaggctttggggatcgataacgataatactgagctctggaaacaccgaggattcggcacatcttagttacctggtggtgatggctttcttggtgaatgtaatcaaaaatattggttacttctgcgcaaggaagcccagagccttttttaggatttcgttctcctcagacagcgaagccagtcgcttttccatcgctttgatttcgtctggcgatttaccggattgagttttggcctggccctggatccacttatgaactgttgaatagccaatgccatattctctggccagttgggcagctgatttgccttgcttatataggttgataatgttttgtttgaattctttgtcgtaacgagttggcgtgtaaaaattccttccttttgagagacgatttattcattatatgctctcttaaaagttgtctcaggaatcagcttacatccaaatgttttagcaactctcttttgagacagcgtgtgtcagtcaagaaagggagtttttattatgacacaatttaattttattcaatcacaaaatgcttatggaactaagttttttcaactaccacaggtattattatatggcgaaaaatataaagaactaagtgacagtgcgaaattaggttatgtagttttgcgtgatcgtttggaatactcattgcaaaataattggatagatgatgaaaatagagtgtactttatttttaccaatcatgaattacaaaatttatttggttggagtgaccgaaaaatatcaaaagtaaaaaaggagttggaagaagcaggactgttattccaaattaatcaaggatttgatcccaagaaaaagaaaaatttacccaatcgactttaccttgctgatttggaagttacagcaaaagacgtgtatattaaacaggattttgctaataaaacggctggaacccttgatacaagcggactagcacaaatgagacacaatctatacaatactaataacttagatactaatagatacaatatagatactcaaaagttggacttttccacagcccatttttcatcagcagaaattcaaaaacaaaaccaggatttggtgaaccatgctaatgacttcttaactgatgaagacagtggcttaccggttttcttagaacccgaagccgtgcaattactaagtttctggtgccgcactccgcaacaaatgcggcgcttcattggcattatcttaaatactaagtaccgagttgagaaagatcacaaagatattggtgtcataatcccactcgatgatgaagaactaaaacctttgatgactaaagccttgagacgctactttaacgccctaagaagcaatgagaagcacatcaagaacgtggaaaactacttgtacggcaccatgcaaaacctatttggcgtttggtggaataaacaagcggctagagaatatgcggccaaacacgctaacgatgagcgtgtttaaactaaaaagctatataaggccatttaagctgttttaaacagatagagcataattatattaaacgagttttaaaatgcgcttacgggcactttaggaacgttgtataagtgccattgcggaaaggacagcaaacttaaattcacaacttttaaagaagcaggctaattgagatggtactcaaagattagtataatgtgagtagtataaagggggggcgagaaaatcatggcagttaaggaaaagaaacgcgtacaagtccagattgacaaagaattggcagataataccgaagccgttttaagccagttaggtctaaacccaactaccgcgatcaatatgttttataagcggatcgtagctgacgcagcattaccgtttaaaccagccctgagcgaagccgaaagagctaatttaagccttttaaaggctaccaaagagacaccagtaacagagttcaaagacgctaaagaagtcgctgattggctcaatgatccagatgaggactaatggcttatcagattaaataaattaataacttggaagtgtgatgaacatgaaagatacaatcacaattaatgacttttttgaaattgccaaagaaactgatttaaaagaattacttgataagtcattacatgagccagatccagaaaagcgcaaagtatatgacgctttatatacctactttttagataaaaggcaagatgaggttattaagcgaaaggactttgtccgttgatagataaaccccaatatataattgttgctggtattaacggagcaggaaaaagtacgctatacgatacatttcccatcttgtttgacaaaacaaaacggattaacgctgatgaacttttaagacaaatgggtggcgattggcataaagatagtgacaacttaaaagccatgagagaagaaatcaaacaactacactatgctttagatcaccagcaaagtattcacgtagaaacaacactggcaggtagaggcaaagctcaactcaatttgattgacaaagctcacaaaaatggctttgaagtgactttattatatgttgctttgagagatgaaaatttagctatccaaagggtcaacgaacgggtacaaaaaggtggccacggtgttccagtagcaacgatcaagaaacgttatcagcaatccaaacataatttgccattagtggcctttaaatctgataaggtcatgatctatgataatagcgaaaagtttacctctgtttatgcaagagagaagggacaagtttttaagaacgatttgaggcattttccttggataaaccaaaatattacttatccagaaaaggtgcaaaagcagttacaaaattttgcagatcaaaacccagaagtaaagcctaaaaatgatccagaaagtaaaaacgatcggcctagttattaggttgatcgtttttgagtttattcggtttatgggcgttaacatagtcagcaaatgtttttaaaagttcttcggtttcttcgaccgataggttatcagcttgaaagtatttttcgagcaaagcccctttttgaattaatcggcgagaacgggctttgcgggcttgccgattttcatagtatttagattgtcgtaatttaaaatcttcccgctcaattttttgttttaaacgcgcttgctgctcgactagtttttcatattgattagacatggaatttccccatctcgtatggctaatgatctacggactttacctttaaaaattcagaaaattgcttggctaaaagcttaatctgatcgttagacaaattagcataatctaaattggattgactgatgatttgtttacctagccgttgttcaatcttatttttttcgtccttaattttttgattaagggcttttaatttagcttcttgtttttctaagttactttgagccataacgatccctccaatcatattagaaataatcaccgaaactatatcatataagaaacgttaagtcaaagtataaaatttgaaatagcgaagcggaaggcatacactaagttaaagttaagagaatcagaaggccgagtgaaacgaggtcaatgcgcacttacacatagaatttattctatgttgtgctaaccccccaaaaacctgtattagaagtcgccaatggcgacaacaaaggcaaacccataggatcaaagtaaggaggtaactaatatggcaatctttcacattagttttagtaatattagtgctggtaaaagacgcagtgccattgccggtgccgcttatagaagtggtgaaaaattatttgataatcaagaaggccgccactatttttatgcccgatcggtaatgccagaaatctttattttaacccccaaaaatgtaccagaatgggccagtgatcgagaacaattatggaatgaagttgaaaagaacgatcgtaaatcaaactcacggtatgccaaagagtttaacgtggctttaccggtagaattaagtgaatccgaacagaaagaattactgacaaaatatgtgcaaaaaaattttgtcgatcaaggtatggtagctgacgtcgcaattcatcgcgatcacccagacaatccacatgcacatgtgatgttaaccaatcgcccatttaaccccgatggtagttggggattaaaagcaaagacgcagtacattaaagatgaaaatggcaagcaacttttaaccaaaagcgggtttccaaaacaaagaaaaatttggttggttgattgggataaaaaagaaaaaattaatgagtggcggaataattgggaaacaagtgtcaatcagtctttagcacaaaaaaatattccggatcggattagtgagaaatcttttgtcgatcaaggaatagatgatacccaactcagcatgagggaatcaatagcaaacgacacgaacgaaaatcatttaatcaacaagttagagcacaaagaagcgctaaagctaaatatcataatcttgacgaaaagattagaaatcatgaacactttgacgcgttaactgacgagctatcattctctgaaaaacacacaattagtcatctaagtcagcaattgaaaacctatgtcgatttagaacatttagatgataaacaacgcatgctatttaattggaaaaacagcttattaattaaacacgcggttggtgaagatgtaaccaaacaactgctgaccattgaccagcaaacgacatcactagcacaagctaatcagttgttaaataaagtggtagaacgagcaacgaaaaagctttatccggaacttgattttgaacagacaaccgcggctgaacgacgggaactgattaaagaaactaatagtgaacaaacaattttcaaaggtggcgaattggcagaacggttagcggatattcgaaacgacttattaacccagcaattattgacgtttaccaagcggccatataccagctggcagttagtcaatcagcaggcccaaacaattgagaagcaattaaccatggtactagccaaacatggtcaccagttagacgatttgaagcatactgatcggggcatgctagccgtttatgaacctaacgaactcgaattcatttctaaagcggtcaaagatttacgggtcatgcgggaagttaaagccgtggtgcaaacccaatacgacagcattctaacgactgcttttccggacagtgacctcgataagctagagacgattgacaaggagcaaatctataccgctgtggtttactatgatccagaattaaagccattaagcgccaatgatcttagtcaattgcaacagcagccaccggtagtctttactagtcagcaacaccaagccggtttgaattacctgttaggtaaaattgaattaaaagatattcagaaccaccgattacaacgggtcttaaaacatgatggtacccggcaactgtttatcggcgaatgtggccaagatcctaagttggataacaaacaaattgaaatggtgcaagcccgtttgaaacaacagacaacgcggtttgatcaatataagcaagaccaaattaaggactatcaagcgatcaattattacccaactagcccgaaaaactacctgactaatattttggacgaagccttaataaccattttatatgcgaagaacacagactatctaagaaagcagcaactacgtggactaaaggagactgagtgggaaatgacgaaaaagcaacggcaacaccaaactcgaaactggcatgaagatgggggcatgcacttgtaatcacaaaattagcgactggttaattggtatgaatggtagcccataatgtattttacaatctaccatgtacgtgtcgtatattccgcaaatcatttcgaatttctcaggtgacccagtatcgccgctacaaccactcgtggcaatgattaatgggatattatggactggttacggctggttcaagacttataaggattggcccgttattatttcaaatgttcccggggtgatttttggatttatcactgttttaaccgtatatattcattaaccgaatgacaaattgactgtaaactaaaagtccgctgatacgtttaaacgcgtatcggcggacttttttgcaaggtgttaagcgttctttaaagcagcctgagctaacaataggccaccggcaatgccagaattgttacccagtccagcgggaacgatatagtcatccagtggtgggacttcttcgtagccatttagataggcggcaaacttttcacgaatcatgggaaagagctgccgttgattcataacaccaccgttaagaataattttatcaggtgcgaaggcgacggtgaggttgacacatgcctgtgcgatgtagtcagcgatgattggccagaccggatcgtcaacgggaatatctttcccagctttccccgttcgttttccaactgctggcccagcagctaaaccttctaaacagatgtcatggtaaggacagttggacttgaaatcgtccccattttgctttaactcatcgctcagcttagttttccgaccacatcgtaatcgcttgtattcggcatctgtttgtgctaattcagcctgataaggttgacatcgagataattcataagaaattgttgacggtgatcggttcagccgaacgcccattggaatatcggacagccctagttcacaaaaggtttcgattttaattcgttcggaataggttatactagacaaaagatcagctcctaaaagatgggtttgtggtaaacaccattttaaaggaagttgatcttttttgtccgaacagcgttcggattaattttacaatctaccatttcaatttagaaaatatttccagttccatcaaaacggagctaaacaagatagtgcatgacatcgatgactaatactttaacaccaaacagaaaggggctatgaatatatagggtctataattaacaaataacccctcgaaaacattgaaagaataacccccaagatctataatatagatcttgggggttatttgttttaatattaaagaaatgacttcttctatttgtcatcaatactaaacaataatttgtacaaagtgattatttcttctagttcttcacgcgatacatgatcgacaatagtttcatcagtgacatgtcttgcccgtaaatctaaggctatggtttgatctaataatacttttccatatactgtttgactactagttagtcgatgatacattggaaaattacgcttggtactgctaattggagccacaatcgtcatgttacttgtctgacagactagatcattgcttagcgcaatggctggtcgcttattcatctgttcatgaccacggcttggattaaagttaacataaaatatatcaccttggcttaccattgaagttcattaccttctgactttccccaatcaagctcgtgatcccttttcccgtcatctttccaatccttaaatagttcgtgaatattggttgggttcttttttattggtgttaaaacaattgatccattttcaatggttattgtcatatcttggttatcatctaatttcagttgtttaataatttggctaggaattctagcagctttcgagtttccccactttgctaagcgtgtttgttctttaataagttccatattttcccctcctaaattattattacaagtcaagtatatcccatgtagatacacaatgcaaatattcttactggaggtcatttacatgcaacaagttgtcttacccatcaaagattcaaacgttcttaaagaggttcaagatacgttactcaataactttaaagctggccgacgtaactatacgatttttcaagttggtaaagcgacgctactgcgagtgagtgacgttatgggtttaaaacagaccgatatttttaatctggacggttctattaaacaaaatgcgttcattcatgatcgaaaaactggtaagcctaataccttgtaccttaaaccagttcaaacagaactcttattgtatcgtcaatggctgcttgatcataaactagcatctgaatggctctttccttccattcaacaccccgagcgacatatcacggaaaaacagttctacaaaattatgagtagggttggcgatctgttaggaattaattatctaggtacccatacgatgcgcaaaaccggggcttatcgtgtttacacgcaatcaaattacaatattggcctagtaatgcacttactaaatcactcaagtgaatcaatgactttagcttatttgggcttggatcaagcaagtacagaaaacatgttgaaccaaattgattttgggtaaattggtttgattttgttgtcgccaacggcgacttctaatacaggctttttgtgggttatcacaacatagaatttattctatgtgtaagtgcgcattgacctcgtttcactcggtctgctgataaccatagagtcgatttttccgttgttgaattgaatgtatttttaattaaattatgcttacacttaactaatcttgttatgatttaaatttttgcagagattctttgtaaacttagcaacaaaattttacaatctaccttaaggccctcattttcctttgggtctaatgatttccaaatagaaaacaacgaacatagtgaggccttagcaaacacaatactagtcaatacccaatttacaatagtgattcgaaagttacgaacgtcagtgagttactctaggtaagtgctttagcacttactatatataatatgaacaaaggtaattcacaaactttacactcacataaacgctcatatatcaacgttatcaagccactaactagcgggataaatatttcatggtcaaacattatctaattctacacgtttaacaccaagcaatcgcacgtcatagcacaccgtatagccccactaaaacgacttctaagaggctttgaactatgtcacgtgtaattttaccttgatatgctaaaacgtcttaaatcgtattttaaaacaggctcgtcaaattaatgacgggcctgtttgtatgctggaattttcacactattatgaagtggatgtgtcattatgtcggagacacaagcttgattatagcactatgcaaacttggtgtaaccactaaaaaatgagcacccgggtaagtgctcaccaagaagttgtcacattgaaacgaaataccacgagtcccgactaataggacaactttattttagatcattctaattaaattgcaatattaaaaagcgactacctaaacagatagccgctcccccaagtaatatagatagcacatattattataataacattaaaattgacatagtaaaaaggcctatccagttaagggaagacctttttattttgcggtatgttactgagagtagtgtgcaatgtcatgtcatacagcacaaacgtagtatagcattattaacgctagttgcaaccactagagtagttaaaaaagcctattcaattgagaatagaccttactgtaaacacgaaaaactaagttatgagttcattcctgaacacactttttaagtatagaacacacattaataacattaaaaatagtatagtaaaaaggtctatccaaactggaataggccttttatcgtgctcagtcattatcagactgttaaatgattgaagggttactaagtaacttgaccgagcacatatcgaagtacacatacttaacgatgactgagtctagcaaaacttgttaggagtgtttgcaactaccagagtcagttttcattatagcactattttatgctagttaacataaaacacagtattcaaagctaaactttgtgaagtgtgtaaaacgttgttatatcaacgatataaggctatatatttaccaatatcatgcgataacgatactttgtgataatgacgttctatgtataattgtccgaagtgtctcggcttagaaaacgccttggccgagactatatcaactaaatagtgtgtctatcgttagtagttagttcttaacgtcttgtggtctacgtgactactagtatattaaataacaccttaagtctagcaccaacccgcacgcatagcggtgcttaaaccatcaagggtcaagcccttaggctctctcaaacagttatcctaatcgtgaataactgcgcttcttttgcagtataaagagagaactctttatcagacaatttaagctcaaccagcccttgcactaactattattagagttggttttagcagcaacccgaataatctgcgttaatagttagcctgtccgtatcatttcctagtcttccagccacgtctttagtcgcgttgatctcgacaaggtttagcatacctatgttgttaactgcaagcggggtcacgaacgacactcacgggaggttttactagctaagaacaggtttccagcctttagttgctttgatggttgctaaccattgaataacaaaaaaacggttgctatcaggtttctgttaagattcccgataacaaccgtttactttaagtatcaatggttgaaaaacttagcctacatgttataatagtaccaagttagatagcttgtattggtagtacttgctatcgaaaatcttatcaggttgtgctgataagtcgtgaatcctaactctgctaagttgagggttcctttttttgcgttcatttattaagttgagtacattataaccgtaatataagattaatacaacctttatcattttaacgtctcaaccagccgaataagccttttttaagcgttttagtttcttcccccttgtaatgatccccagtgggttctaaaacgtctgtatcgtcctttgaggcgtcctcgctggtcttttgtggggcatcgagtagtttttcattttgacggttagtggataagtttaattgctgttgctgatcaagtaacttgtgggcttcgcccaaagattgctgaagcttttcgatctgcttatccttttcaaccaattgcttttctagcaactccattgctgtatccgtgacgctatcgtgtgtaacataattactgtaacttacactctcgttacttacaaccctgttactacttaaaaaatgctgttttaaaagcttgtatccatcatcacttatcgtcagcttgcttactccgttactatgtaccttacttacatacttacttctaaatttatcgtccatttttcgcatgatagcttgccttgtaacaccaaactccattgtaagttgtttcatagtcttactcatgttacttacaccccctaattttactaatattaacatagttaatcatggtaaacactgaacgagggcttagaatgcgtctctcaacaaaacaaaggcactcccacaacgagaatgcctttgtttactagtattttagctgattaatcaacgcccgctccgtgcgtggggcatacgttcggaaaattctccaatagcctagcagttggccaatggattttgtaataaaaaatcgcatgtttgaatttttctaacagttttccaacatttttccaacagacacattccggcattgtatatttagacaaatccctatatataaggaatataacaatatatatttatatatactatatagtttgttagaaagtaagaaaaaaagtccccagaaaaaaaattatttttttcttaggaacctcgatatttttctaacattcttacaaccgttgcgggagtaagtaagaatcgtgttaggattaaattttattttctaactttctaacattttgttaagtgaatgcggtgctttcgtcggtaataatatagcactgctggcggtattttacaactctttcattggtaagccaaaaatataacaaaaaaagccactgtttccagtgacttaatacttgtgtgggacagtgactgtcaaccatattggttagcagtttttttgtcgatatgaaaatattctttgggtgcgtcattcggctttccttgcttccaatgactttttgcagaaccatacttagtcggttcaggattaggactaatcgcaacaaatcgacgcccaactgaatccataaatatgattatccgacgatattcttcagttggtgtaatcaacgtacagttttcatgcttaatgccataaacatctgtaaagtccatatttcacattgctttcccgtatgtttcagtgccataaaataaaaaactgccttattacaaagcagtttcatcagtatcaaaataaattattgtggaacaacattcgttgcttgagggccacgatccccttgttcaacttcatagcttaccttttgaccttcatcaaggcttttaaacccatctgtttggattgatgagaaatgaacgaatacatctttattatccgaaccggtgataaatccaaagcccttatccgcgttaaaccatttcacagtaccactttgcatatacttatattcctcctagaaactaaatcaaagtaaccagccgaattaacatctaagaaaattatagatagcaagtttaatgatacttaaaacttccgaatatgttaaccgtgttcagtatatcacagagttcgaagatagtttaatttaaacacttcaagtgcccggttctttaagtagttaaacttgctgacactaaccgataattgattacaggcttcgttgcggttgaaacgtttctcaataatataatcatgtaggataaattgatattgcggatcatcaattgtattgagggcgtcttcgacttcttttaactggtaagataagtcaacctggtttaccaggcggctttcagtgccgtttcggctactatgactggatactccatcgaatgagggactagaaacttggttaaaagttgtcaagtcacgttttagtttggcatattgttttaataaattacaaatcttcttaacatcttgacgcattagaatcacactttctgatcccagatatatgtataaaaaagcggggctattacaccccgttccgactaatatcaacacaatgaataaaactatgcaacaagttgtcttacccatcaaagattcaaacgttctcaaagaggtgcaagataccttactcaacaactttaaagctggccggcgtaactatacagtttttcaagttggcaaagcgacactgttgcgagtcagtgatgtcatgcgcttaaaacaaaccgatattttcaatccggacggttctattaaacaaaatgcgttcattcacgaccgaaaaacgggtaagcctaataccttgtatcttggacagcttctcaaggacccacatcctaaatctaactgttcactacgtgttgttgggccagtttgacactcggaatgtatattccactgatgttgacgacctcaacctcaatttaagtatagtaaaagaggtatcaagattgtcgtcacaatcttgatacctcttactttaggatgtttgacgtagagccgtattacttgatattggttttaattactttagttaatgctttttgagcttttgtcagactagagttggccttcttcaaacttttacgagcttgagtcttagcctttgtagtcttagcttttttcaaagccttttgatacttagcaatttgagccttagttttagcaagttgagctttagcagttttaactgccaattgatgtttaggttgacttggattaaccggatttgttggagtagttgactttgtcggttcagttgacggttgagttgactgtgttggttgaactgattttgtcggttgagcagtgacttggattgtgctatttgctgacacagtgctcgtcgtgttatccaaatttgtataactataattgtaagttagcgtgtattgaccaggtatctttggcgtgaaagtatctgcggaagctgtcgttgtcacaccatttgggtctgtgaccgtaacagagctgatagcaccagaagccatttttgatggatcagtgattactgcatttgcaccgttcaacgtgacaagtgttccgacgatccctgacgttggtgcattcgttggtgcagatatcgtgggtaccacagatgtggcataaagcgttccttgctgattaatgccaatctgaactgaatgtcctgctgtcatcggcaccataatatctgcgccacctgcattgagcttttgtgctgtactccaatcattcgttgttgtaatgataatacccatactcgaagtactcagatttgacaaggtcacagaatccgcagagccaatgcttaatgggacgaaatgaccgtcataagcagtatttcctgtcccccaaacataagcataaagttgcttccccgtataagctgttgatggccaaaaagtaattgtcgcattttgagcagacgttgtgtctgcagtaccggcagtgcctgtagtaccggcagtaccggcagtgcctgtagtaccggcagtacctgtagtacctgtagtaccggcagtaccagcagtgcctgcagtagatttagaaagttggataatggtgaatgtcaaatttgacagagtgacagagctattcaaaacttgattagctgttaagctaccatcattagaaatgattacagttttgcctgtcaaatttgaattcccataaaactgaccaccttgaccaattgtgaccgaattgccactagcattcaatacgactagatatttggtcgcacccgatgttaattcttctgtgatcactccgtttgacgcatttgtgacattttctacacctatactggtaggagtccaagcaagtttgctataatcatcaggccaaaattgcggattggattttttaaatttaatcaaatttccaataaaactaacagcgttttgattgtccctgacattatcccaatctatggcattgactacatcccccgcaactactggggtgtagagattactacctggccaataattgccatggtaagtaccattactatccaagccaaaaagtccattgtatgaatttttggcagtatcccatgacgcaggataccatgcaggtttttccatactacccgattgataagcctgtgtctgtgtaggggagagcggcatcagatttgacggattgactaatttggaccgatcaaactcctgtcctgtttccataaatgtcacaccatttgcaagaatattcgtggcatttgcgaacatcacccgtgcttggtgtgtcgccacagaatcattcggattagctgaccatagtgcgtcatttaaagtgaagctatcatgacattcaacataattgacagactggcttggcgtcaagaaggcttgcagtgtgccatttccgttccaacctccagaacccaaaagtgctcctgcaacctttgcggtacttgccgtatttcctgatacaaatccatctgcggaaccgccattattactgatggcgtcacgttcactataattgaaaaatccaataccaggaacctctttgtaattgttgatagacgtttcagaaatattgttttcattagaatccataaaaccttcaccgtacatgataatatgtggatcaagtgctgtcagttcggcacgcagtttattcataaccgtgcggtctaaaagtgtcatttcatcaaaacggaagccgtcaatatcataattcttagcccagtaaataacagagtcaataacgtatttaccaaacatttcgtggtcgctcgccgtatcattgccacacccagattgcgtatttttgcggaaataatagcccggctcggctttttcaaaagcggatgctgactgactatagacgtgattgagaaccatatccattaccacgctaatcccatttgtatgcaagccttgtaccatttctttcatttcattaatacgtgtgacaggattgacagaattactggcatattcgccctctggtaccatttcattttgtgggtcatatccccagttgaagttattcggttgcgcagtagtacggtttcccgcttcgttgaccgacgcatactgactggctggcatgagttgaatgtagttaaaaccctcgtttttcagataatcaagtccagtcgctgtacctgtatttggatcagttgttcctgactgaatcactccgagaaacttaccacgattaccagccgaaacaccagatgttgatgagcttgtaaaatcacgaatatgtagttcgtcaacgatggcttgtgttggacttgctacccgccaagttgcagatttgccttgcgcaagtaccagatttgaagcgatacttgcaggtgatacaacaaccgagcgatttccgccttgtgtcgttgcaatagagtaagggtcattagttatattgatgacaggacttgtagacaatgttccataagttgacccagcataatcattaacagttccattatcataagttagttcataagcatacaccatgccattctgatcgccaggaacagtcaaagaccaaaccccaatcgtattggttgcgtgatcatttggtgtcgctgatgtcccacgtgtcattggtgtcactgatacctgtggtgctgtcggatcagtattcgtaccataacttatcagtttcacgcttgtcgcagttggtgaccagattttgaaagtagtaccggttggcgaatagttaaatcccaaatctgtcccttcataggcccattttttatcaaaaaatgtaaaatcattgttttgtgtggcatttttctcgtcagacagagcttgtgtagcatattctgatgaagattcggttgagttggctgcatcggttgagttggctgcgtcggttggatcactaaagctcggtaaccggtcaaagtcggctggcttgaccgcatcaacgtcggcaatcacactgcggttgccattaacggtgaccggtgccgtcgtttcagtcttcgtgtcaacttgggccggggcactgactggttgggtgaccggcgccggtgtctcaacttgactgtttttcggtgtggcggttttggccttttcgctagtgaccaccggattagtcttcgctacttccggtacggcaaccgacttagttgaagaagttgactgattagtcttcgtgtcaacttgggccggggcactgactggttgggtgaccggcgccggtgtctcaacttgactgtttttcggtgtggcggttttggccttttcgctagtgaccaccggattagtctccgctacttccggtacggcaaccgacttagttgaagaagttgactgattagtcttcgtttcaagtgacgattgcaggtctttttcacccgttagcgtgctggtcgctgccggcgtttgggatatcgccacgtcggttttcgtcggctggttagcagctgggtcgatgcttggcacctggtccgtttcggcaacggttcccgattgttccgcgttggttgtaccagttgtcgttgtcgttgccggtttcgcaaccgattgcacggccgtcgtggttgtttgagtatttgacagcgtatccgcttgcactgtcgtggtcgacaaccccataccgattcccatggctaagaccgcacttgacgcatacagccactgtttcccgtgtttccacatccgccaatttccctgaacaacatcctgattatgcatattctgcaacctcctaataacattctgttcacccttgaatctaaacctagacaaattggtactcatgccactaggctaatgtaaacgtttcaataacgcaagcatttttcaaatgttaacgttatcattattgttaggtgctataaataattgacagtggtcaacgctgtactaaacaactgaccgaatcacgaacgttgcgcaactaatgaccagtgccgatggttaacttaggttggttaagtcagctacccaatcaaaaactcgggatggtagtggccaccccgagttgtgttaattattatgaacctcatcaccgaattggtacgtctgtaggttggcgacatttaagaacctgtttaaaatctagctaatttggtatgatagttcaaaaaaggtgatcagtaatgaattatcccagtaatatttctcgccgacaatttgaactagtccgtcccattttagaaggtgcacgacaatcaaccagaccacggaaatatgatctttacgacttattttgcgcggtggcctatgttttaaaaaccggctgtcagtggcggcagttaccagttgattttcctcgttggcaatcggtttattattattatcgagtatggtctgaagaacaagtccttgatgaaccttctattttggatcaatgcttaaaaaaattgtctttaccctacgggaaaaacagtcacgctcggctaaaacatcttttataataattgacgcccaaagtgttaaaaatactgataccgccaagcatcatggttacgacggtggtaaacgaatatctggaataaaacgtcacttagctgttgatattaacggtttgccacaagcaatccatatcactactgccaatgtttctgaccgtgatggggctagtgccatgctagcgctaaactgtgaacatttacaacaagttaaatcagttcttgttgatggtgggtacaccggggacaacttcgccgccactgttcaatccaatttaaaagccaccgtacaggtggctaaacgcaatgagctacataaatttgaagtgttaccacaacgctggattattgagcgttctttcagttggttagataaatgtcgtcggctctggaaaaattgtgagcggcaccttaattcaagtcgccaaatgatcattctcgctttcttgatattactcttaaaaagattttaaacagattctaagaatatcgccgactttataccggttagatttcgaaagagactcttgttcgaccctgatctgatcaactatttgtgttttctttcgtcctttgaggttccgaacagggtcattgatttttttaagatttcgttctccaattttgcatcatataattcttaattctttttcgtcaattcttcacgaagttgatcgatttcgttcttgtttactaacttacgtaatttcttcttattatgtttcactttggtttttctgcctttcggatgaggcttcaaggcttctataccatactgattgaaggctgtcctccaaagactgatttgacaagaattaacatcaaattttgcggatacttcggctaaagtttcattatgagtttgatagtagtttatcacatcaactttaaactcaactgagaaacttcgtttaactcttcttcgtttaagagcgtctgcgccgctcaaacgaaagttttgtatccatctacctacttgtattcgaggcaagttacgtttctttgaaagaagactgatactaatgtcaccttgaagatattcactaacgacttctgcttttaattctgaactatatttgaccatagaaaaagtgctccataactattagatttcttgtctaacaattatggagaactttacctgtcttagattttagaagtatcacttggtttctcaattaacttaaaccgtcgctgcaatttaacgatgacgttactccaaattaaccagcgaccgcttaaaatactcgactggcaaacaccgtatcaggttatgctgacaaatttgtccaaaaattcggattaaatttgcaatttaccgtatctcttaataagatagtcatatgaaaaagaaaaattaaccttcgatgcatattaataatatttctaacgttcataatgagtttgaatcaatttattataataagaattataaatagtttatcgacagattttagagtttctattaacccgagccaatcaacgatgctgctaagccggttcagggtggtcaaacagaggctactaattttgtaggtcaatggttgccttgaactgatgaaactgaccaacgacatatgacactgaggggcttattactattagtcatgagtagtttgttaggactcctcggaatgactaagcggcagcaaaaagaataggatgatattatatgctaaatcatcagcaaattaagaaccagtttgagagcttaacaaccctgcaagctattcagaatcaggcataccagatgttagtgcaaggactggccaaaactgaattttcaatgcgtgagtggggaatattagtctatcttgaacaacatgggcaagctacttctagtgaattagctgatgcattcacggtcacgcgcacactaatttccaggaatacttggcgattgattcaagataatttaattcaatcacaagtgaatccaaatgatcgacgaattgtttggctatctttgactgttaatggccaagaaagggtccaggaaggtgttcggcaagtgcaagcgaacttaaaagctttcaaccagagtcacaatcttgagaagttggctaaatatgtggaagatttgtcacaacaacttgctaggataaattaaatttttttcaagataagtcaagatgtactaatgtaaataaagatcagtctgttaaaatctttgggttttggcagaccggtcttttgttgaagtgaagaaaatttaaacattaagattattttagtcttgtgacaataatcatttgtatacctaagtaattaatcgagcattgcaagtggcaaagtttctcaccattaaaaaagcttagatatatttagatacaaattttttgacgttttgaatatgtgataattaaagtgtttaaatggaacgaaccaggtcacaacttaacaattaggcttacaagaaacacaaaaagagcctgagcatgatttaaaaaagctatcagcccaaacacttaataagtcgtatcaaggcttgcaacaacaaattcaacaagtaactactccacaacagaaagcgcaattaaaatctttttgttgtattttatcaagggcatactttcgtacagggtctgtcatgattattacctatttttctgaagtttatgataggcacaaaaaagtgcgttattgtggtctatgatatatataggtatatattatatactataagtaaaggaggaattttattatggcaaaatcagttgcagttttggtgactaatctagtcgaagacgttgaatatactgaacctgtagaggctcttaagtctgcaggacacgaggtgacaacgatcagctttgaaaaaggcactgttgaaggtaaacatggtactcagattaatgttgataagtccattgatgaagtgaatcctcaagactttgatgcattgttcattccaggaggattttcaccagatcaattacgtgcggatcaacggtttgtcgaatttacaaagttctttttggcaactaacaagttaacggcatctatttgccacggtccacaattaatgattcaaaccgggttagtgcaaggtcgtacaatgacagcatacttaactgtacaacctgatttgtattatgccggtgcacgcattgaagacaaagatgttgtgatcgatggtaatctaattactagtcgcgaaccaaaagacattccagcatttaacgaggccttcctagcagctttataatgttgatggttgataagcatataaacatgtaccaattatagcttgacgagtttggctgctttaaaataaattttttaaacagttaccattaaagtaacttagtcctcgtgttagtagcacggtgactttttatatagcattttttaaacctccgttgcgaaattaaaatgaacttatatttctaaaacatactaattaataaaaggccagtcactaaccaaaaatcggtcagtgactagccttttattttattcataaccaggctgcgcttcatgtcgaaaagctagaaattggttagataaatataatataacttatgaagaacaaaatatttttcaacaacctccaacaacagaagagattgtaaaaatacttaaattaacagaaagagggactgaagaaataatatctaggcgttccagaggttatggaaagttaaagggaaaactagctgatttaacatagggagagttatgtaaccttattaatgaagaccctcacttattgagacggcctattattgttgacgagaatcgtttacaagtcggatacaatgaagaagatattcgcaaatttcttccccatgaaattagaaaggaagagttttttgacataatgcatgaagataagcgacttcgaactggtaaattctataattaatccgaacaaaaattaaaaaaagcccaaaacaatctcttacaatggtagtagctaattccaaccaactataaggagcgattactttgggtatctctactttatcacgttttcaacgtggcgcgctagcacaactagtcagtgaaggtcatcatacttaccaagatatggctgacgctttaggcgttgccaaatctaccattcactatgaattgaaccgggttaaaccttatgaccctgaattggcccaacaagatgctgaccgcaaaagacgggcttgcggtcgccattcgattctaacatcatcattagtgactttaattaccaatcacttgcgattaacctggtcaccagaagcggtcgcgactgcttttaacttgggtaccgcttcaatttataattggcttaatcgtggctggttacctttcgaattagctgatctacctaatcgaaatatccgacagtgtcgagttaatgaacaccgtggcacatttacaagtgggacttccatcgaacaacgaccaacaattgttaatcagcggttagcttttggtcattgggaagtagatacagtgctttctggccggaaagagtcacgagcatgcctggtcacttttgtagaacgtaagacgcgacttctatgggccataaaagcccctaaccgaactgccaaggccttaaatagcgcctttgaaaagtttatgggaacctttggttcccaagtgaaatctataactgttgatcatggtaaagagtttgccgattatcaatccatagaacaagactatcaaattaaagtttatttttgccatccatattcaccatgggaacggggttccaatgaatatttcaatcggcggttacgttggttcttcccgaaaaagactaactttggccaggtaacgacagatgaaatcctggcagcgcttgaacttattaaccaacggccattaaaaatccatcatcaacagactgccattgaaagattccgggcttgttcggattaaacttgtaatttgccttttaaaaataatccagctgttttatcggcaattgttagcgcttcaattgaaggctttgctcttcgaaagcaaagtgactacttgcttgatttttttaaaacgcgaattaaaaatcagcagccagcaccaatagagattgcatattattcgggcgctatttttgctagtttactatattggcgagaaaacgattatcaatattccgcagccgagttggccgagcacctagcagaaaagagcaaaaatgatttactgcaaactggcgaaaaaatattttagccggttaatggaaaaacaaaacaatcaaaaaaggggtacggcaattttacttttgcagtgcccccttttactaggctaaattactttgttaggccatgccctagggtttgggtttctcgtaaataaactggatcggtcttagagatttgggaattctttgagcaacaacctagtcgatgacgacagcaactgtctttttggggtttaagatattttccaattacaaccccagtagctaaagcgattgaaattaaaattaaatgctgctttttcatgaatttttcctcctttgatttagagtaacttttgagatttcaaaatttcttcaagataggtgccatgaacctttttcaaaaaggcatttagaccaattttttcaatttgatttaaaggcaattcggtcaagctctttttatcattcaaataatataaggcacttaagattgttcgtaagtcaaaggcagaatcaaagacttctgggatgccacgatcaatgtcaagcagtcggtagacagcttccatagcagttctgacagagtattcagttgtaaagacggtgtctcgctcagtttcggcaaagttcccaataaaagccaaattgcttgaaccttcagggacaactaagggacgatcaccagcttggcgtggcataaagtatgaagtaatgtatggcatatgaattggaattgaattagctgtttgcgcgatctcagcaatttgattttctgggacaccaatatgataaagaaattcttgacagatttctgcgccactgcaatcagtaatttttttgtgaatataatttccgggctgatcggaaaagagaccatataaccatacgattaattcatttggcttttgttgttgaaaatgtggttgacggctgatggaaattcctaataaccagtttgagtccctaatggagactgggccactggtaacaattgaaccactatacggatctttaccagtaattttttgaatatagggtacgattcgatcgtctttaaaggtgcaagttgccgacatgacccagttagccgctggaatatcttgataaaatttagctggatgtccgaaagctgagtcttgagccgctaatttttcccataatttccagctagcaccgattggatgcgttgctggtgctgaatgttcattgtcaccataagtagtgctttcagtaattgatccatttgtaatgaaaaccaaatcgtcaggtgttaggtcgaggctttgctgattaccatcgatcgttagctcaattttaacagcttgtttttgttcaccggtttgttcaacaataatattgtcaacggtggtattgtattggaatttaacgtcgtgatcttcaagatatttaatcagtggtttgattaatgactcatattgattatatttggtaaatttcaatgctgacatattttgcaaggtgccaacatgatggacaaagcgtaataaataacggcgcatttccattgcacttgcccaaggctcgaaagcaaacatggtggaccaatagagccagaaatttgatttaaagaagtcatcgctgaaaacttgattaattttgacattgtcaagttggttttccggtgttagcactaatttggcgatttcttcaattgcttttcgggaaagcgtcaactgaccatcactggctaactgattaccacgtttttcgattacgcgggtgtgtgaattacttggatcggctttatttagccaatagaattcgtcaagtaccgaaacactggcatcttctaaggtaggaattgaacgaaaaagatcccaaagagtttcaaagtgaggttccatttcacgcccaccacgaataatatagccgcgttgttcatttaaaatcccatccatgctgccaccgggaagtccaagttcttcaaaaacatgaatttggtttccaggaacctgaccatcgcgcactaaaaaagcggcggcagctaaaccggctaaaccggccccaacaatataggctgatttcttggtggcatttgctggttttttaggccgagcaaatgcttcataattaccactactgtagtacatgaaaatccctccttgtaaaataagataccaagtatttgttacatctgtaactaaatataatataaaacggttaacaaatttattcaatcaaaattattttctcaattggtagattacaaatttaatccgaattatttgcaatttaaaacgtagtctccaatattgtatttagtatgcctcatgggaatttgaggctggctttatggatttagattttaaatcaaacaagtatgatctttttgatgattggcatcaaaacaagactaaacaagtctttacacaaaagttgcagcaacaagctcaagttgaaaaaacacaattaccgcaattattgtcgcgtgaagatttaaaaattcgttggcagatgaactctcgtcaaagtgttcaccaagttgccagtaagcctgattttccacaacccgtttttgcttttaatcatggtaagacgccgctttacttaacaactgaaattcaaattttcgaaatcaatcacccctgggtgataactcctggtgctcgtcttgcttatagtcattggattcttcataatgtgattgattaaatttgagatttagctctaggtctttgatcgttggcgctagccttctaatacaaataatccccatcaaaatgaggattaaatctacccttgacacttgtcaagggtgtaagtgcgcattgacctcgtttcactcggtctgctggtagctatagaatcagcttattttatctggaaagtaacacagaataaaaaaacaattattcctgatcgtacttgatccatagccaatagtattgtagattgctggcaactagggctagccaaatgattgctaggagcgtttgtcccagttcctgagacgagaggcgccaattcaacagtaagcagataatgccgagcaatccgtatagaaaataagtggcactgaccataactgtggaatgaactttaagagtaatcagccgatcacgttcgtcatcaacccagtaaaggcctttaaatgacttgacgccgagttggtgccgcatgtaccagagcatcgcgacacaggtgaccaccaacacgagcgatataatcggtgcccagatataaaacagatgactgaaactgacaataatcagtgcagctagcaacaaaaatactaggttgttcacccaaaatgtaaaccgaagaatccttttagcacgactcatttgacatcctccccattactgaataattcatcgaccgtggtctctaaaatggcggctaacttgaatgcgagggatagtgacggatcatacttattgttttcaatcgcattaattgtttgtcgcgtaacagcggtcagttgggccaattcggcttgtgacaatttccgctgtttccgccgagtggcaatggtatttttcatcaatattcacgtcctcatgtcaaacatctttgacaaacttagtaaaacatattttacattcatagtcaatatagtttcggtcctctttggttatacccaaccgactgttctcgttctttgtaagcttgtctcttactcctatccaaattgagcttctttaaaaaatctccagccacggattcctccagcggtttcgactgctttcaaccaaaatttttaattgctttatgcagagaatcttcataaacctggcaacaaaatttgaataactaactgtaagaactgcgtatctaaactgaaatcattattttaatgttaggagtcattaagattgacgaaaagaaagtattaaaaccaattgatgaaatgcttgctgatccttggcaagttgatattcaagaattgtttgaaacttctgtcaatgaacctgacgagatcaaaagaaatttgtatgattccttatacacttatattttgcaaaaaagacaagaagatattattaatcgtcctgacttcgttatttagccctctaaaagtctgctgagggctttttatttttgctttggtataaatatatataaacagtctcaaaatcgctagaaacgagaaatagggcccttaaaaacgaatatagcagttagattcttgttaagattccaaaaaaaactaactgtttgctgtcaatggtagcggacgagcaaagcgtgggagcataaggaattgacagctcttaaccagtcttaacactgaaatggcgaaagccaaagttttgtagaaaccttgctttcctgcctaacggcgagtgaaaaagctgtcaatctggctcagcttggacggggttcggggcgtcagcgccccgaattaatgtggcttgccacaccttttaggcaacgaacagagtgaggcgcaaggagcatagcgactggagtttaatgtgagcctgttttttggctcactcctttgtgttttttgattctaggttttgacctcgtacagtagtgcctcttttaaacctcttttataaacctcttttaaacctcttttagacccctattgcgccttactcccccaaggcgtacagaagtttatcgactacattttgtctgtttatcgactacattttgtctgtttatcgactacattttgtctgtttatcgactacattttgtctgtttatcgactacatttatttactcctgtattcaaataaggtagtattattcaaggaggttattttatgagcaatgaattagtcaaatatgaccctgaattaaatacaatccccttgcgaaggtttactcctgtagaaatgaacttgttcttttctgtagtttctagaatgcgtgataaaggtgatgatactgttagatttacctttgatcagttaaaagagttaagtgcctataagccaaccgcaaataatcggtttattgatgacatacaaagtacatatcaaaaaatactaggtcttagatttggctctcgaagcaaagatggtcttgatagagagatgtttgtcatgttcactcgatttgaaattaagggatctgcagacgttccttatgttgatattcaaatttatcccaaagcgttgaaacttctaaataatctcgaaagttgggttcgttatgctttgacagagttccgagatttaaagagtagttacgcaaaaacaacttttcgtattcttaaacaattccgaaccactggttatgcttatttttctaaaaatgatttctttgaactactagatattccacaaagctattggagtaagcctgcgaacgttgaatctagggttattcgcccaattaaggaagaactaacccctttgtttagaggcctaactatacggaaaaaatatggtaaaggtcgtgggaaaccagtgattggttatacttttacttggaagcctgaaagaaaagacgcaaacgacttttctcaaggtaagttccaagatgagcgtcaaaaactttttaatatccagaataatggtgaattaacagaacaagaaaaatggcgtgctaccgataaagttaaaggcctaccactaggctcaactgaaaaacagattttagctgaacgacagattgagcatgataaaacaataagagatcagacaagacaagaaatgctttctgaactccgaaaggggtttggaaaacatgcctaaaactattagagaacttgctgatgaattgaaggtctctaaacaaactattcaatatcactaccaaagactaccaacaaagaaccaacaaaaagatagtcaaggtacaaacatgatcagccctacagctgaaaggattattagagacaaagtagcaaagcctttggtagcaaagaaccaacaaacaggtagcaaaaaagcgacaaagactagcaaagaaaataatgagctaatcgctactctaagaggagaagtagcagatttaaagtctcaacgtgaccaacaacttgttaccaaagatcagcaaataagtagcaaagatcgacaaatagatcatctaaccaaattggtagatcagcagcaacgcctagccttacaagataaaaagttgctagaagaatacaaggcggagaacgacaatctcaaagctcttaacatgccctcacaggacacgaaagaggtacaaaatgaagtagaagagacaacagaacctcttagaaagtggtggcagatatggaaataattaaaactgtaaaggatagatcccccatattacttgggcttgtgattgctttaatggtttctgttgttttaatcattgcaggttttaaagtgaagagtcaaagcctaactactagtatattattatggataattggtgtggtgggaatactaatttgtttatatcttattctgttctcaatcttttttggcatgaattggtaataggagtaatcactaatgttcataaggtgtaaaaaagctttgacaaattatttttatttttatttcaaaagacgttaggctgaatgaattcaatcttcttgatatgctagattcatgaaaggagacattatggacataggtaaacggataagagagtatcgaaaaatttataatctttcccaagaacaattggcggacaagatttttgtttcacgtcaaaccgtatctaattgggaaaataacaaaacatatccagacatacaaatcattgtttcgttgtctattctatttaatgtttctttagatgaattaattcgagaagatttggaggaaatgaagatgaagattagtaataacaaagctactaaacgagctaatatttattctttaataatgatttgttcaacaatattagccagtctatctattggtttagtagtagcattaccagaatcaaagtttatatggatagttccagttactttatttttacctgcgttatggagttcttttgttttagaaaaattcaaaaggaataatgacttgaaaacttataaggagattttagcattttcacaaaataaggatgtagaagttttaagaaaaaaaagagacgctagaagaacacggattgaaaaagggattattgttttaggctatgcaggtcttacactgttgatttgtttaatggctatatttattgcaaatttttttaaataataaaaatccctaaaaataagcaaaagagaacgacaaaattagtcgttctcttttttccatttttcaggtttttgttcattgacaacatgggcaaacattttagaaaaactttccgtgtcttcaatgcttaaatgttcacactcaaaatacttttcaagcaaggcgcctttttgtattaatcgacgagaacgttcttttcgttttttagagttttcgtaatactttgattgacggagtttaaaatcttcattttcaatagcgaggtgacctatgatgtagtcgatagctatgaaaaaatgatggataaattatcttaaaaaatgtaaacagggaccataactatcaaataggcctttgatcatttctaaagccattcttcagaacgttattacgatctgaagaatggctttattggcttgtgcaagtaacatttgcgtgactaatgctagtaattcttgctaggattgccttagagtttcgattttaattcgttccgaataggttatactagacaaaagatcagctcctaaaagatgggtttgtggtaaacaccattttaaaggaagctgatcttttttgtccgaacagcgttcggattaattttacaatctaccgataaaggtcttaactagttgctatgttctcagttatatcatgattgtggttgccgtccttttacattatttacctttctttaccctgctcagtttagttactattccaattgtttctcaacgaattcatactttcatcagtcacccagataaaatgaccacctttttcaacattttgatcagtttgcaattcatcctaatcagtgaaattctgtttacgatcgttggcattctaatgaactttaggtaatcaatgttcgattatatttgaagtttaatccagcaatcatcaggcacctctaaatttgagctgcttatgaattaactagtcatgaagtgaacaaaacgctcttttggttctcttgataactagtacattcacatatatttaatgctttattcaatttctggattgaagatgaacaataataagtattccaaataatcatcgctttaatttatgattgacttaaatattagggaggctttacaaatgaatcgaccttacgtcttagttcacatgatgacatcaattgatggacgaattgattgtggaatgactgctcaactggctggtgaaccagaatactattcaacattggatagtttaaatgctccaacgcgcattagcggtcgtgttactgcagaaacggaattagctagtggtaataagtttgtttctaaaaataatgagcctattaatgaaaccacctttgccaagaatgcaacttctgataggtacttataactgcttttatccgtcaaaataggtaattcgcttgctaatgcttccagttcatttttcatgatatatcctccttcttttacaattacactcgttggttaggttcactttttggtttttgaaaagtaaacctaaatgacgggttcaccaaccggaacaacgtgaagggcggtaggcaggttctaatcaaaatcaaaacttaatttatggccgtcaagctttaacttggcgtcaaacgacttcccctttttgctcttgaaaccctttaatttgctggtttcacccttggtaactaacgctttaattgcggtcttcccgagcgtcttgctactccatttcttaggtaaggtaaaatcttcaccttgcttgggcttcacaatgtaaaacttctgtttatttaaaacggtcgcttgcggtgtttctaagaagacctcggcggctttttgggcttgctgctgatgattgatttgttgcttaatggctgcactgccagttaattgcgtgggaacatcagcgatcaactttgccacgaactttttgatttggctcaaaaagttatccggggtgcgttcttcggtactgatttgttgtaacgcttgctcccattttgctgtcatttctgggctagttagcaagggttcaagttcgaccgctttacacaaagtaatccctgcttcactgacgtgtaacttgttcttttcagtgacgagatagccgcgtttttttaacacttccagcacattggcccgggttgcacttgtcccaataccttgcacgtctttgagaatcgcctgggcttcttcatcatcaagcgttttaccggcggttttcatggccgtaatcagggtaccttcggtaaagggtaccggtggtgtcgtttctttttgcggcgtttgcaggtttgcttggacttgatcgccttggtgaacgagcggtaaagttgctgctgcttgctggttggctgtgtgatcatcaaataatgcttgccaaccttgcttcgttgggaccttacccgttgctttaaaactggcatcgccgacttgagtaacaatggtggtttcctcgtactcatatggatcagcaaacatcgctaacgtcgttcttaaaaccaaatcatagacctgttgctgtaatttaggtaaggcagctaattgatctttcgtcggcacgactttagtcatgataatggcgtagtgttcttcaacctttttcccattaacatagcgcttattcggggtggtattggttaaagcgacttgcttagagactaaacccagatacttcgtcagattagccactaaatactcaaattcttcatcagtgatataagcacaatcggtgcggggataactgagtagtttgtcttcgtataaactctgaatggccgccaaggtttggctggcactggcatgataccgtttattcatcgcactttgcagactggatagcgaaaacaactgtggactagcactctttttagcctgcttttgcacgtccttgattaaaccgccctgtgagcctttctgaacgtgtttagcttgcatgaatgtcattagccctgtttcatctttaaaccgctgataggggtctaattttgcgacgaatttttgctgattggctaaaatttccgcatttagttcaaaatagggttccggcttaaagtttttgattgcctggtctctttgatagaccatatataaggttggcgtctgtactcgaccaatcgaatacaccccgcgtaccccgttttgtcttaataacaaagtatataaaggactgccattcataccaattaaccagtcactaatttgacgggtttgggcttctttataagccaaatagtctttgtgccaatcaccaagatttttaaagccggtaataatcgcgtctttttctaggctattcaaccaaaggcgcttaatcgttttcgacttaacatcaatatgcgcttggttcatgatcgaccacgcgatatttgacccttctcgaccactatcggtggccacaataatggtatcggctttcgttaacaggtctttaacgatcttgaattgcgctcttttactagttgacacttcaaacctgtatttgtctgggaaaatcggtaaattagataaggcccattgctggtatttctgatcatatttatccggtgtggctagttcaactaaatgtccgagaccatacgtgacaagcgtattatcgggcaaaacagggtcactaaccgtatagtaaccctgtttttttgtgctcttttgaaaggcttggacgtatgaacgggcttgactgggtttttcagctaagataacagtggtcatgttcgttcactccttatgattcagcttttgttctaattctgttttgccttgttcagccgcttttaaccaggtttaacggtgcattttttattccgattacaagtgcatgcccccatcttcatgccgatttcgagtttggtgttgccgttgctttttcgtcatttcccactcggcctcttttaaaccttgcgcctgtctttgccgttggtaatcttcatcacgggcatatagagcggccatgattgcgtcactaaaggccgtctttaggtaatattctggactaactggcttgtagttcaatggttgataatgtgccagctgggattttcgatattgatcgtccttagcttgttgctcttttaactgtttttggattttctcaatctgactgttcttgatcgttggatcgactttacattcacccaaaaagagttgtttagtgccgtcatgctttaaaacccgttgtaagtgatgattctctaactgatctaagctaagctgtcccaataaataagctagtccttgttgatgttcctgggtattgaaaaccctcggtgggtttttctgccactgtgcgattgtttcaaccttgcacggttttaaagctggatcatagtacatcacggctgtataggcctgttccagtttaatcattgggagttcatctaaatcaccattgggaaaggctcttttcaatacttcatggtattgcgtttgaatgacttgcttaactgccatgattgtccgtaggtctttgacgtctctcgtaatcgtttgctgttctgctggtgaatacttttctagtaggccttgatcaacgtgttctagactttctaagctatcatcatgaatcatcagtgtatatttaagttcgattttgacttccttttcttgttgcattaataactgccagccaacgtatggccgtttggtaaaggccaataattgtcgggtcaataaatcatcgcgaatattcattaaacgttcgtttaattcactgcctttgaaaatcgtttgttcactattagtttctttaatcaattcccgtcgttcagccgcggttgtctgttcaaaatcaagctctggataaagttttttagtcgtgcgatcaactactttatttaagagctcatctgctttttttagtgaactttcttgttggttaattgtcaataattgcttagtgacatcttcaccaacagcgtgcttaattaaggtactgtttttccaattaaatagcatgcgccgcttatcatctaaactttccaaactaatataagttttcagttcgtggcttaactctttgaccacttttttctcgttaaacgagaagtgtttacttaggctatccaagtggcctcgattaactactttctcctgcatatttttatagccagctttggacttacgatagttcttaacttgttgattaaatgcctttctttcatgccgtttgctattgattccctcgtgttgcattggtgtgtcagctattccctgttccacaaatgatttttcactgattcgatcaggaatgtttttttgctctaaagctctgtaaatattaattaagtcggcttctaaatacggtgctgtatgaagcatgtacccacgtttcttacgactaacaattggagaatctcgtttgttttttaaattattaatagccttccagatggtttcacgactgacttgaaactttttagctagatagtcaccagatacccacgtatctaaattagtcaaaagttctaacaccactttttcttgggttgatttatttttcatcaaaccacctcctaattaaatagcgataaacaataactaaaataagcttaaatgcattgcttttctaatacggcgaacaataataactgctaaagcacttttaataagatctcctggtataaatgctaagtttgaaataagagcggcaatcagcgtaatgtgagactggtaagagagccatatagcacccaccaaatcaataaaaatcactccggctaataataaaatgagcagttcaaatatccaagacttattgtaaatctgaaaacgattaattaatagaccaattagtaatggcgtaaataaccaagctataagatagccgccagttggtccaataaagacagccataccaccattaccaccagaaagtatgggcataccgatgaaggctaataataaaaatagacatactgagatggtcccatacctaggtcccaacaactcaccactcatcatcactcccatgttttgtaaaacgataggtactggaataaatcccaacggaataccagggaagaggcctaatataattaagattgctaccatcattgcagataacgttaataatcttgtggtgttactacgtttcaatatgatcactccaagtatggatttttcaaaaacagtgttattatagctattagtaacccattagtaaagtaaagggttactaaaatccgaataatggaagggagactgctaattttgattagtttgaaaacaggcgatctgttacttgttaaaaaggcacaaaataaactatcagagatgatcattagaggcacaaaacaaacgtttttagatcgaccactagcttattaccatatcgggatagtagaaaaagaaggcactgacttttttgttctccatgcaaccaaagaccatggttgcattcgtcaaccgttagatcaatttatttccgaagaaggattgattgacgtttatcggaagagtagccctttaataaattccctcaaaatactaaaacgagccaagtccatgttagaagcaccatacaatccgagcttcagattagatcagccaggatattactgttcggactacgtggttaatgcatttaaagatgaaaatatatttcatctatccccaatggtatttggccctaacggctctgttttgcctgaatggcaacagtattatgaaaatttagacttgccggtacctaatggtcagttagggagtagtccgaactcactaattagccaaggccatctcaaatttataggagctatcaacagctgacttttaatacagacaattatttggccatttaggtgaacgattacgtgagtttaaaacacgatcttgctggatatcccatatccctgatattaaaaagactacaatctagatagctggttaatacggctatctggatgtaaatagtttgccttataatcttggaaaaactatgttttatttttatctcagtgctcaataatcgagtctacaaggtaaataggagagcgtaaaatatcaacgacatcataaccggttcccatgattccgatatacttcaatcgtgatgttttgctgctccatttcttgggtagggtaaagtcctcgccttgcttgggtttcacaatgtaaaacttttgtttatttatgacagttacttgtggtgtttctaagaacacctcggcaactttttgcgcttgctgttggtgattgatttgttgcttaatggctgcactgccagttaattgtgttgggacatcagcgatcaatttcactacgaacttcttaatttggctcaaaaagttatccggggtgcgttcttcggtactgatttgctgtaacgcttgctcccatttagccgtcatttctggactagttagcaagggttcgagttcgaccgcttcacataatgttatcccggcttcactgacgtgcagcttatttttttcagtgacgagatagccgcgttttttttaatatttccagtacatttgcccgggtcgcacttgtcccaatgccttgcacgtctttgagaatcgcctgggctgcttcatcatcaagcgttttaccggccgtcttcatggccgtaatcagggtaccttcggtaaatggtaccggcggggtcgtttctttttgcggcgtttgcagatttgcttggacttgatcgccttggtgaacgagcggtaaagttgctgcttcttgctgttcggctttgtgatcatcaaataaagcttgccaaccttgcttagttgggaccttaccggttgctttaaaattggtgtcaccaacttgggtaataatggtggtttcctcgtactcgtatggatcagcaaacatcgctaacgtcgttcttaaaaccaagtcatagacttgttgctgtaatttaggtaaggcagctaattgatctttcgtcgggacgattttagtcatgataatggcgtagtgttcttcaaccttctttccattaacatagcgtttattcggggtggtattggttaaagcgactggcttagagactaaccccagatacttcgtcagattagccactaaataaccaaattcttcatcagtgatataagcacaatcggtgcggggataacaactgagcagtttgtcttcgtataagctttgaatagccgctaaggtttggctggcgctggcgtgataccgtttattcatggcactttggagactagatagcgagaatagttgtggactagctcgttttttgccttgcttttggacgtccttgattaaaccggcctgtgagcctttctgaacgtgtttagcttgcatgaatgttattagccctgtttcgtctttaaatcgctgataggggtctaattttgcgacgaattcttgctaattagcaagaatttcagcatttagttcaaaataaggtttcggcttaaaggttttgtttacctggtctctttgatagaccatacacaaggctggcagctatacgtaactaatcgagcacgctctacgtaccaaatttttctcaatataaaatacattatgggctaccattcataccaattaaccagtcgctaattttgtgattacaagtgcatgcccccatcttcatgccggttccgggtttgatgttgccgttgctttttcgtcatttcccactcggtctcttttaagccgcgttcttgtttttgccgttggtaatcttcatcacgagcatatagaacagtcatgatcgcgtcactaaaggccgtctttaagtaatagtctggactaactggcttgtagttcagtggttgataatgtctgatattttcttttctgtactggtcgtccttggcttgttgcccttttaactgcatttggattttctcgatctgactgttcttaatcgtcggatcggctttgcattcgccaaaaaagagttgtttagtgccatcatgctttaaaacccgttgtaagtgatgattttctaactgatctaagctcagctgtcccgataaataagctagtccttgttgatgttctggggggctgaaaacctgtggttggtttgcttgccactgttcaatcgtttcggcctgacatggctttaaaacaggatcatagtacatcacggctgtataggcttgttcctgtttaatcattggtaattcattaaaattgccgttaggaaaggctcttcttaaaacttcctggtattgggtttgaataacttgcttaacagccatgattgttcgcaaatctttgactgcgcgagtaatcttttgctgctcggttggtgaatacttttctagtagaccttgatcaacgcgttctagactttctaagctatcatcatgaatcatcagcgtatatttaagctcgattttgacttccttttcttgttgcattaataacttccagccaacgtatggccgtttggtaaaggtcaataattgttgggccaacaaatcatcacgaatgttcattaaacgttcgtttaattcactacccttgaaaactgtttgttcgctatcggtttccttaattaattctcgtctttcagcttgcgtggtctgttcaaaattaagctctggataaagttttttcgtcgtgcgatcgaccactttatttaagagttcatctgcttttttgagtgagctttcttgttggttaattgtcaataattgtttagtcacatcttcaccaaccgcatgtttaattaaggtgctgtttttccaattaaatagtatgcgccgtttatcatctaagttctccaaactgatataagttttcagttcatggctttactctttaactacccgtttttcattaaacgataagtgtttacttaggctatctaaatgacctctattgattactttttcttggttgtttttataactggctttggccttgcgatagttcttaacttgttggttaaatgcttttctttcataccgtttgctattgattccctcatgttgcattggtgtgtcagctattccctgttccacaaatgatttttcgctgatccgatcgggaatatttttttgctccaaagccagtcgcgtaaactagtttggtgaacccaaattgccggtgaatttcatcaatcacctggtttaaccggctatggcgaatttggttgcgcggggtttcaaataaattaagttgttggccggagttggcacttagtttactgctataaacgctaatattccggacagcttgaccgtcccaattctgacggaataaccacaataattgttgcgtcaaaacttgattgtcattagttggttcaatttttaaagtctggttaaaaccaccgcgaccatctgcttcagctgcagcataggaaaacccaatgcttagcgatagacaaccggccagtttatggtggtgccgaagccgcgccgccacctgtcccccaatttctttaatgacggtttcaatttcgacttggttaaaataatctcgtggcaatacttgcgaattacccaggctagtttctttaaccttagttggttccgtgacttgtgcgcgatcaattccccaggccgtagcaaataattggccaccaatgacgccaagttgctgtttgagtaaataagggttggtgtgggctagctcatacatattgtgaatttgaagccggttcaaacgtttagccatacgggggccaatcccccaaacgtccgttaattcgttgattgaccaaatcttatccggcaccgtttcgtaatggatttcaccgatcaattcatgattatgtttagcgtaaaggtctaaggctaatttagcttgcaccggattgtcaccaattcccacggtggtatacaagcctagcttttgccgaactgtcttttgaatcaagcgcgccacttcgcgaacggaattgccaaacagccgccaagtatgggtcatatcaagaatgctttcatcaatcgaatacggccaaacctcttgttcagtggtaaattgatgaaagatctgattgatctgcaaattacgttgaatataaaggttcatgcgcggtggcacaacccacaacctggggtcattgggtaagtcacgtttacgggagacgttggctttaagatgaaataagtgcttagcttcgggtgacgtggctaaaatgagcccgccattagtattttcagcttcgctaaggaccactaacgggacttttaagggattaaggccccgggcaacggcttcgcaactagcataaaaggacttgttatcgattaagaagaacacgccatgcggttcatcatcaaaaaacatttagatcacttccgttagcttttacctgtattgtagcatataaagcaaacgtgtgttccctaaaaactggcagaaagttgattaaaaatagtcgaaagtccattatagtcatgttataatgtaaccagaaaagggaagtcccgctagaacagggcttcccatgtagagccgttaaagacggtggcagattttaacgatatttaataaccgctagctgaccagagctaaggcggttattttttttgctgacttttgatcagctcaacaattaatgcgattaaggccacgataaaagtaccgaaagccagcattaattgtaaagcgtccgacacggacacctaggctactcctttcgttaggatttatgggctttaaaggtttaacaccataagcaccacctccgattggaaacagccaccgccttaacttctctactggatctattatacaggcagcctagctctttaaccaaatataaaattaaagaatcagtaagaatactatatttatatctgtaaaaacagtttttaactgctaggtcataatgtatagataaataaaagcaagcacctatgtaaaaaagtgcctgctttgattaattatcaaaaaaattccaatctatatttataaagggttatctccccaatttaaatattgattaactgatcttcaattgctcaattatttacgttctaagaagcctaatacagataaatttgcaatctaccgaatagctatgttatactatttttaattaaagaaatcgtttgagtatcgagagttcggttagtggctacacacaatgacccgacagcaacgtacaagggaagccttgcaacgtgcttcaatgtagattgatattctcctaagtaaggaaccgcttagtgtgaatattaagcggtttttttagtgaaaaaatatttaggagaattactatggaattagacaattcaatacagcaaatgataacaaaagatttagtacaaaaaatgattacttctatgggtggacaatcgaaaagtagtatttcaaacattgattcaataacattaactgttttagaacaactttatcgtgagttaaattttagaccgtgctcttgggctacttctttagtccatgcaaataggaaaaatgatttaattgatgaattaataaggttgttaggttatcaatcagtgatgagcttttgtaattaaataaaaataggccagcagattacactaagtagcttgctggtttttattacgttaaaatcggttttaagacgctttattatgcttgggtatatataagcaatgcaccttaaaatcgcttagaagacgttttgaagggtctatacggtgtgctgtgttttggcgtgtgattgattggtgttgaacgtatagattagatactatttggtcgtgaaatatttatcctgctacttttattctaattctaccaaatattacaattcattacaaaaacggccttatattacaagcaccccctaaaaacgtaatgttctgattattgcactgcaagcactcactagttatactagtcactgttgattggttgagacatcaactgctcgaccaatagaaaatatatgtaaataattgaacacacgcaaattataggagggtgtattaattattatgaaaatcaaaaaccttgtattatcatcaactgctgcattagctttattcgctatctcaacaacggttgccaacgctgatacttatactgttaaggccggcgatactgtttcagcaattgcccaagctcacaacacttcagtttcagccattgaaaaggcaaacaagttagctaatgttaacttaatcttcattggtgataagcttgaagtcaatggtactactacaacaaccacgacttctgctgctacaagtgctgcaccacaatcagcaactagccaagctacttcttcagctgcttcaactgcaacgagtgccagtgctactagtgcttcttcacaatcagttgctagccaagctactagttctgctgctacttcttcagctgctagccaagcttcaagttctgctgcaaccactagtcaagcttcatcaagtgctactagctcagctgcatcatcaacagcttcaacaacctcaacgacttcaacacaaacgactcaacaaacgaccacgacacaatcatcagctcagactagtcaaactcaagctcaaccgagccaagctagccagacccaatcaagtcaaacacaaactagcaaacctgctgctcagacgacgactcaaacgtctagttcaacattaaactatagcaacaatgattctgatagtgctgttaaggcttggattgctggtaaagaatctggtggttcatattctgctcgtaacggtcaatacttcggtaagtaccaattaagtgcttcatacttaaacggtgactactccgctgccaaccaagaacgtgttgctaacagatatgttgcttcacgttatggttcatggagcaacgccaagagtcactggcttgctaatggctggtattaaaaagccactttaaattaataaataaatgcaaagattgcggatcatttctgattcgcaatctttttttctactattaaatccgtgctgaagcacgtgtgtccccccaccaatacccattacaaagttactcagttgctaagtgactttataatgggccttagagcatgctgacaacccgttatttagatatgcgatatgcttattctagcaaccgctttaagacggacacgatccagacctgctagttgtctcccctaatcgacgacccactctcccaaccaaaataccacatgtttttatttaacaattcaccaaccttaacggagaaaatccaactaatttcctgactaagtacagtcccgaacccccgacagtttgacgactagtccacaacgacaaccacataccattcagctatggcataatactaacccagtaacgttttagtagcgatcgtcatgggctacttttggcataaacctactataataatacttaattaatcgacgccttcgttaaccgaccacaattgactacacgatgcgcaacttctatcaattatctgctttaccgaaaaataattagtcagtaccacgtctccacgcaataaaatgactagttaagtgtcattgtaatcagaactcccgacaaattaacccgtcaaaattcactagttaagcgcttaaaattatcgataatcctcgttgacttttcataaatcgaccaaaagtgatcacttttatcggataaagcggctaattttcatcattagtttccccgcttaatcattgtcgttattgattttacggctggttaatcggattggtagcgctattttacatgaaatccggctcaaatgatagattgccctttgattctatgggttttgaccttgttgtcgccatcggcgacttctaatacaaaatttaatcacgatttaccccacaagaatttagtggggtgtaagtgcgcattgacctcgtttcactcgtcctgctgattatcttaaattcacttatagtgtatgccttccgattcgctatttcaacttttatcctttgacttaacattctttgtatgatatagtgtcggtgattatttttaatatgattggagggattattatgtctcaaagtaacttagaaaaacaagaagctaaattaaaacagcttaatcaaaagattaaagctgaaaaaaataagattgaacaaaacctcggtaagcaaatcattagatcagcaaatttggattatgggacacttaccactccacagattaaaatgattgctaaaaaagttgccacctttttaaagcaatctcaaaataaccaataatagttaggtggtaatgactatgcctaatcaatatgaaaaattagttgagcagcaagcgcgtttaaaacaaaaaattgagcgggaagattttaaattacggcaatctaaatactacgaaaatcggcaagcccgcaaagcccgttctcgccgattaattcaaaaaggggctttgctcgaaaaatactttcaagctgataatctctcggttgaacaaaccgaagagcttttaaaaatatttgccgattacgttaatgcccataaaccaaataaactcaaaaacgatcaacctaataactaggctgatcgtttttattttctgaatcattcatgggatttctaatttttaaatctggattatttttaacaaagtcatttagttgcttttaaatggcggcttcaaaggtaatttttggatttatccaaagaaagttacgcaaattatttttgatcacctggtcatgatctcgtctgtaaactgacacaaatttttggctattatcatagatcacgacattatcagctttgaatgcgactgctgctaaattatgatttgattgtctataacgtttttcaacaacttcatctggtacaccgtgcccacctttttgacccgttcatgaacccgattaattgctacttttttgttttttaacgccacgtataaaagcgtgacctcaaacccattttggtgagcccgctcgattaaatttaattgtgccttttcttgaccagataaggttgtttcaacatgaatactctgcccagcatttaaagccgcgtggagttgttttatttcttcgcgcattgccctaaagttgtcacgatttttatgccaatcgccacccattttttggaggatttcatcggtatttaatcgtttggagtgagtaaataattcgggtctcgcgcgatataaagtgcttttaccagcgccgcttatcccagccacgatgatgtatctctttggctcactcatgttaaatcacgaaatgcttgtcattgataatttgctcttggtgtttatctaagaggtaagtgtgtaacgcgtcaaacagtttgcgtttatcaggatctggattatatgccgcttgttcccaaatgtcttgaatattgactgcccaggggtcagccaacaattgatcaattgtttcgatttctttgctgggtttggtcatttaaaaagctcctatcccgttttttcagctcagctatcgtcaatttggccacttaaggcacctatttttacttctaagcgattttaaagcagttttaatataattatgcaccgcaacaattaaaacggcttaaatgagctaatatgacgtttgattccaagaacgctcattgtcagtgttctgttcttcggggtgtttggccgcatattctctagccgcttgtttattccaccaaacgccaaataggttttgcatggtgccgtacaagtagttttccacgttcttgatgtgcttttcattgcttcttagggcgttaaagtagcgtctcaaggctttagtcatcaaaggttttagttcttcgtcgtcaagcgggattagaaccccaatatcttgatgatccttttcaactcggtacttagcatttaagataatgccaatgaagcgacgcatctgttgcggggtacggcaccaaaaactaagtagttgcacagcttcgggttctaagaaaaccggtaagccactgtcttcatcagttaagaagtcattagcatgatttatgagatcctggttttgtttttgaatttctgctggtgagaaatgggctgtggaaaagtccaacttttgagtatctatattgtatctattagtatctatgtttttagagtctttatatagattgctttcgattttcgaaattccgatcgtagcaagggatttcggcgtttcttgtccatattcaccccttaaatagacatcagtagctttcacatcgagcttggaaaggtataaacgattcggttcattctttttcgttttaggattaaatcccatttgaatttgttttaatagattggctgtttgtaattctttttttattttaacggctttttcagtagcgcagttaaataagtcttgtagttcttgaacggtaaaaataaagtaaacatgattatcttcatcaacccaatgattacgcaaagaatactctagccggtctttcagtaccatataagccaatttagcatcactgcttaaatgtttatattgctcgccatacattaataccttaggaaactggaaaaatagggctccatatacgttatcggcttcatagtaattgaaatttgttgattttgtcaggtagattgggaaattaatccgaacgctgttcggattaatttcccaatctaccttaatgttaaaagtttcctgaactttgtgagtaacatgtcaaaaaacataacatggatagcgacacatgacaaacagtggtataatatgagaaattttaattgcaagctaatcttattttaatgtttgaggaggctctatatgaaaccaaaaattgttaaaaatcaagacggaaccatgcgatccttaagcaaccgccacgtccaaatgattgcaattggtggaacaattggtaccggactgttcctcggatctggtagtacgattagtaaaaccggcccgtcagtaatgttagtttacttaatactagggttatttttcttctttatgatgcgggctattggtgagatgttttatgcggatcctacacagcatacttttgtttcattcatttcaagatatttggggccaacaatcggacattttactggttggacttattggattggtttagtatttgtttgcatggctgagttgactgcaacagcgacttatgtccagtactggctaccaagcgttcctgcttggattattgaattagtttttttaggaattctggtgagtgtcaatttaattgcagcacgattatttggggaagctgagttctggtttgccatgattaagattattgctataattgccatgattttaactggtgttttcatgctcataaaccattccgtcaccccacttgggcacgtatcattaacaaatattagtcatgattacacactattcccacatggtatttttaattttattgctgcatttccaatggtattttttgcttttcaaggaattgaatttgttagtattacgattggcgaagctaaatccccacacacagttatactaaatcatcagcaaccgtgtgaacctctaaccgttgccgattcccatacttatctttagcaataccacgataaacatagccgttctgtgtaatcccaaccggaactgttacaggaaatgatccactactaccattaactcgcatgtagtaataatcaccaccataccgataaatatgccacccaatacttaaaattgtaaccccaactaggaaaacaaccaagacaacttctatccaatgatttttaatcgcaaacttactcaaaaatagctccccctaatccccataaaacctataaaatatttaaaactaacttgactttggtctcgacctttgctgttcagaacgcttgaacctgagcgggatatagttttccccttgttttgcgaagaagaaaactttttgttgttcgtcacgaatcaccgtcacgtaaaaacacttgtattgttactattgcgcttgtggattagcctaactaatctagcctataaaaaaagcaccctttataggtgccagcaatcatttatttttagttgtttggatcactggccttgcgtaatcgccctgtactttcgtactgctttaccgcccgccccgtacgtggggccaccgttcggaaccaacctaaatacaagtataggttaattcctagtgggagtttatagcggcggctctcacttgacctgtcgacttgtttcattagctccgctaaccggctgtcattcctcgaaaggtaagattagttggcttggctagaatgttgccactctagtaacggggcttggctcccccgtgatccagaaaaattcaactctacctacttgaaaaatcttacaatagtaggtaaaatgaacacataaactttgataagggttatgtgttcccccggtggcgaccgagggaatttttttgtctattcaatttagttacaaacagtattatacccctttgccgataatatgacaaaggggtatttttaacgtcttagccagccgaataagccctttttaagtgttttagtttcttcccccttagaatcactctcggtaggctttaaaacgtctgtatcgtcgttttgcagaggcctatcgtcctgtgaaggggtgttgttcgtagtggcatcgagtagcttttcattttgacggttggtagacaagttgagtcgttgctgttgatccagtaattgctgaaacttgtctatctgattatttttagccttaatctctgctttagcatcttctaagtctacacgtaattgcttcactagatcactttcaatgtcggtcttgggactacttgaactattataatagctttctatagcctctacagactctttagtaaaattatacttacccttagcatctttcttaggttgattatcagccggtatttctttgattatctgataaatacgaccatttgtaacatttaatcgtttagcaatgcttgatatagtctccattaacattacactcctatactcaacaattataagcctatatctaactaaataatcatagtaaaaggctatgtatagtatattatagtaactatgcactaaagcaagtcaacaagggcttagaatacgtctctcaacatataatataattctatcgtggagagttttaagggtagtggctgtttttgcttgaaaggtggtggtgcgtatgcaatatactgcacccatactaggaaaggttttcagccatgttagcttggtgctggtttggtctagcagtcgcaagacttgcttaccaaatttatcgagacaacaaaaccaaacaaaaaatactaagcttagtattttttgtttgtcacctaaatttaagttttttccaacttttaaccagaatcgttttaatcactcatccatttgaacaatagccagtcctagtttacaacaggtttcgattttacttcgtttagaataggttatactagacaaaaaatcagcttctaaaaaatgggcttgtggtaaacaccattttaaaggaagctgatatttttcccgcacaacgttcggattaattttacaatctaccttaatcaattactactttcattccatatggaatattatcatagacccactttgagtctgcaatacttaaatgtatgcagccatgcgatgtaggctttttacctaaattttccgcaatcgacttaatataatgctgctgtgaatcaaccggtgtagaatgaaataagaattctccataattaagccatgatacccaataataggccccttcattttcgctttcactgtagaaatatttacctctttctgcttgaacatggtaagttcctctgggggtctcgtgtgctttatcgtgaattcccgttgatatatacattgtgtagagcactttatgctgagtcattaagtacattctttgcttttcaagagatacatgaatccacatatctggatattttttcacctctggataaggaataatttcagaggatttatgccaattaattggagtcctcataacttttggcttagtcttcaaagctttcgacttagatttttcaactttggtaacattagcattaacatgttcagaagtatgtgtcctgtttattccataaactaaaattagcccaattgctactaccgtagcacataaaacatatacactttttttcttcaaaaatattcaccctaattaaccacagctacatatcgggttgcacacgaatctgatttgctgtaatggaaaataaactagtacataccgacaaggccaagatagaattacagattttcattgttactacttcctatctatttttttatgtttacagtgtaaatatagtacaaatattcacatatcacaaatttttctccagaataagaagctgttcagacggttctgtgaaaagttgaaacaagagaatcaaatgtaaaaaattgaaaatgaattcttaaaaaaactcgataccttagcacggaagaagtcaaaacacacgaactcatcaaactagtagacgagttaaggcaggagtttcaagtttccatcaaactagttcttaaagcagttcatattcctcgtagtacgtaatattacgctaaggaacatcgtggtcgcgatttagatgattcacaaatcattcaggccattgatgagattcgtcaacaagatccgaagtacacccgtaaatatggataccgacgaataactgatgttttacatgattatggctttaaaatcaatcacaagtggggcttacgtatcacgcgggagcatgactggttatgtcgagcttttaatcaccagaagttaaaatataattcttacaaagggaccgttggggcgattgcgcctaatcgacttaaacgacgcttcaaaacatcggcgaccttaccagaagctggtcgccgatgttagtgaatttcgatacagaaacaagagtcaagacgagcgggtctatttagaaccaattttagagctcttcaacagataagttttaactttcaatatatgcaggagagcgtaaaatatcttgtgtaaatgcataaaagatttctgaattgtatagaaatagggaatgccttcccttatgatatttagtaacgattcgaattgtcagattaagtacaacacgtaacttatgtgttacccgcttataccccatcacggggtatatattttaagttagaaagaacatacgtttgggaatgtcaacctattgttatttccagttgggaggaataaaacatgtcagtaaccaaacttaataatggtaaatggcaagcccgtgtctcttataaggatgatgacggtaactataagtcggttactcatttagaaaagcgcaaaactgacgctgttgagtgggaaactaaaactaagaatgctctgctggaaggtgctgacttatcacgtagtaccgagagtctaaagcattactttcttgattggatcagaatttacaaaactgacggtgtatcgcgtcatactcacgagctgtatatgggcaactggcgtcacgtctctgcatattttaaggataaacctatgagcgcaattaaacgtccagattaccagaagtttctgaatgaatttggccgcagtcatggaattgccacatctcacaagcttcatcaacaagtacacactgcaatcaaggacgccgtagctgatggtattctaaaacgagactttgcttacaaggcacacgtcactggacgccctcctaagcccgtagaggaaaagtatttgacactgtccaattataagaaactgcgtaaatacctcattaaaatggctgattatgatcacatgactatgctgatgatgctgtttcaattagaaactggaaccaggttcgaggaagctgctggtctgacgtgggataatttggatttgaataatggaatagttcacattaaacagcagtgggacgcccgtagacagacttttcgtccaactaagggaaatggacaggccgatggagatataaccataggacccgcctactgtcgttttatgaggagctatcgtaacacgcagaaggattatttagaactgcacgaaatgaagaatcctaagaacctcgtattttggtctaaactaggaaaaatcgtgggcaatgggaatgcaaacgaagagctaggacgtatttgtaaccgtctaaatatcaataaagttacaacacacgccatgaggcatacacacgcttcgattcttatcttaaatcatgagtcccttccctatgttcaacatcgccttcgacatcagaaactagaaacgaccgttaacacctacgtccatcttattgaagaagaaaacggcgtatcagataagaaggccactgagctaatggatgaaggattttagaaaatgataattttgcgattgctgtattccttgtgccacaagggattacaaaatcatttgttaatttttcttccaaaaactgctatattttgactacttttttcgtttttggaagaatcgtggaagaacatatcgtgtttgagtggttttcgagtgtaaaacaaaagcaccaaaacgcctttatatcagcgttttggtgttttgtcgtttctctatatttgtcgccttatcacccgcacggggatcgaacccgtaactccgccttgagagggcgacgtcttaaccaatttgaccagcgggcacaaattcatttattatcttaccgaatgataagcggcttgtcaaatctaattatgattttcgccacctaaaaatcgtcacaataactaatccaacaaataggagtagacaatagacgacactgcaccaaaaaacgaaggtcaatagttgtggtaacaagaagctacgcatcacagctaacccaatagccgtaactgcccatacgatcaattgttgtcgcagatgattgaataaccgatctaattccgacttcgacatacactcaccttcccttcaactagtttagccgccgactggcacgatattcaagtaaaaatgcaaaaaacacgcataaaattccagcaaagtcttgacagtatttgctggaaaagttactattaaatagttgttattgggtattcgccaaattggtaaggcagcggactctgaatccgtaatttactggttcgagcccagtatacccaatcagatttatcggtgaaccactaatgcaagtttagacttacattagtggtttttttgttaattatcacacctttgctagtgtgattttatctttttcggtcaaaacggtttacggacttgattcggggtttataatagactatgtagactgtctgtgaagccttgtaaaatcgtcactattttaaattcaacccaaaggagataatgttgttggtatacaaagatgtttttggtatcgatcacaatgattgtcacattgttcagacgcgacacgagttcaaccggatcttcattattgaaaatgaagttggctcccgctttacttgcatcaaggatgatgccccacttgaaaagaaaatgtccgggcactggaaatatgcaaaagctagcgacgcccctaagaactatgccgttccttataaggcccagaaaaactaaacaaccgttgaaaagaggattatgatgcggcgctatcaaccgttaaccaaatcaaatggccgggtcccccactcgctcaatcataacaccaacccctactatggtcagcatggcgctgactgggtcaaagacacgaatgcttcgctattcaatgcccaacacgagcacctccagtccaggagccatgttgagcggcgggttcggcacagcgttcgccaagtgctatgggtggtcgtggcgatcattgccatgttacttggtggttttatcttgttctcgttagcgatcaatatttaacaacaaaaagagtcatccagtttatcactaaactgaatgactcttttttactagcctttaatttccttggtatccactaaaactttgctgaccattcgaagctcgtcagtcaattcagaggtccgaattcggccaaattcgtcgaggaacttgccaaggcgttcttcgttaactttttcaatgacccgtgccaacttctcacccttggcggtcaacgttaaataacggtaccggcgatcataaggatcgatgtttaacacgatcaagtcattgttgatcaagtaagttagcttccttgaaatcgctgaagaagagacgtggcggtcagcggctagctctttcaccgtgattcggtgatcagtgctatggtcaagatagtagagaatcaggaactgttcgaatgacacatccgcatcagtcaccatcgtttgaatgatctcacgaagatttggctgatagaaaagttttagttgatcgatcgcagtcgggaaaagtacgaccatggcgagaacataagttagagaatttacagtatggtgattatttacaaatgttgcactacaagaaagcccatcgagttaaagagtgtggtgaagtattacgttttgtggaagataaaaatggtcacaaaaaattggctcagacttggttttgccattcccgtttgtgtccgttatgtaattggcggcggtcaatgaaacaatctaaccagttaactcaaattttgacagaagcagttaaacagcgaaaaacgggtcggttcttgtttttaacgttgacggtaaagaatactacaggggatttgttgaagagtgaattacggcagatgggacgagccattgcaaagatctttcagtataaaaaagtggctaaaaatttgttgggttatgtacgttcaactgaggttaccattaatcacgaagcggatcagctgatgtatcaccaccatatgcatgttttgctttttatgaaatcgagttattttacaggaactgataattatatttcacaagcagaatggactagatattggcaacgagcgatgaaattagcttatgcgccggttgtgaatgttgaggcagttaaaccgaatgtgaatcgccataaaaattctttattggctagtgcgcaagagacggctaaatatcaagtgaaatctaaagatattttgactaataatcaagaacaagacttacaagtgattgacgatttagaacaagctttggcgggttcccgccaaattagttatggtggtttgctgaaagaaattcgtaagcagttgcaattagaagacgttgaaaatggtgatctaattaatacgaatggtgatgatcaaaaggttgaccaagtggtacgcgagattgttgctaagtgggactatcagcgtaaaaattactttatttgaatgagtgctatattatatataaagacaggaaatcatttgtctggtgaggggaactcttttatgatttatgctgataagataagctttaatcgtggggacgaaaagcgtttggaaactattgttcgaattcatttattttcgactagtggtgaaggtatttctggctggtattataaagaggatattaatgagtggcttcatgagaacatctataagattgaggtttatatttctccatatcctgaattgattcctgttgatggtgatcatgttaagtatgtccgttctagtaaggacgataatgaagaagataacttgcttaagctagatatctattatgaaaaacaataaggaatacaaaaaataatttttgataatcattgggagctaaagcgacctttgattatttttttgccaacggcaaaaattgcctcgcagagcccaaactttacaaggtaaagtatattgggctataccttgcatggaggtttgccgaattatgtgctatgctctaaccaaatttagctgtttggaagtggagtggttaggtgagttatttagttgctaatatgcagaaattgaaatctgacaatctggttggtttgggtaatcatgatcaacgtcgaacacagaatcacaaaaataccgatattgatgttgaccgttctgttttaaattatgatttggttgctggtcggactaatcatttcaaaacggacattgaggcttatattaacgagcataaaaccagtcagcgagcggttagaaaagatgcggtcttggtcaatgaatggattatctcaagtgatagttatttctttgccggtttaacggcggctgatatgcgcaaatattttgaaacagcgaaggactattttgctgaaaaatttggtgaagaaaatattcgctatgcgattgttcatcttgatgagagtactccacacatgcatatggggattgtcccgtttgatgatgagtataaattgtctgctaaacgagtttttaatcgcacagctttgcgagatattcaagatcaattaccgacttatttgcaacagcatggttttaatgttcagcgtggggttcaagaatcggaacgtaaaagtttgacggtaccggaatataaagccatgcgggaatctattaagcaggggcagaaaaaattagcagcgattgaaaatgaaactaagcagcgccaagcgaaacttaagacgtatcaagccactaaatttgatgtgaatagtgttaaaacgaaggaatcccgtttccataagcggtatgtgctggttgaccgttttgattttgataaacttaaacagggcgccagcttaacagatacgtattttactgaaacattgtcccaaaggtctgatatggatattcaaaaagaccaattgattaaagctgaaagtaaggctatggaactagacattgagaatcgtcgtcttcaaaagctagtcgggacgctacaaggaattgttcggagcgttgaccgcttcttacagcgcaaattaggtgttggtttaccaagtgagtggctagaacgagctggactaaaggaactatctaaaaaagcccctcagaggccacaggagcgttcagaggggcaacatgatgaattagatggtccaagcatttgaatttggtctatggctttaatttaaccgctgatgagtattggagctgtttaatggccgtcagtcaacggtaaatcgaattaaagggacttactgctttagcagttagtccctttttgaggctttaaggagttgattgactaaccaaacccagacactgaattggctgaaagccaaagtttcctaaactttgctttcctgcctcacggcgagtgcggggtgagtttgagcgggagctcccgctcatttaggcggtcaagctggcacagcttggactgggttcggggcgtcagcgcccgagggcttagaaactggtcgattttgaccagtttcttcttatcttgatactattagaaacaacgtcattttaaaaaactgggataaacccttgacacaactgggcttaggcgtattatgagtttataaaatgaataaagaaaaaacccacgtgagaattcctagtttggcgacccggaacacgtgagttaatcttgaatattcgtatttactaaacatagtttaaagcttgagttagtaagcgtcaagcccttagttttagtaaatacataaaagattagctcttctcacgtggttggatgagaggagctttttagtaaacttgttctttgaaaactagataatatcaaatatattttttcataatgaaaccgagaacaccgcgttttttgagttttttattgaagtttaattatcgctaaactcattaatcgcatttaccgttaggtaaatgaggttaagttaacaagggcgcatggtgaatgccttggcactaggagccgatgaaggacgggactaacaccgatatgcttcggggagctgtacgtaagctatgatccggagatttccgaatggggcaacccagcagttttaatcaactgttaccactagatgaattcatagtctagttggaggtaaacgctgtgaactgaaacatctcattagcagcaggaatataaagaaatttcgattccctaagtagcggcgagcgaacggggaacagcccaaaccaaagtgcttgcactttggggttgtaggactgaacatttgagttaccaaagaacttgatagtcgaaggatttgggaaaatccgccatagatggtgatagcccagtagattaaatcaaattctctcagttcaggatcctgagtacggcggaacacgtgaaattccgtcggaatccgggaggaccatctcccaaggctaaatactacctagtgaccgatagtgaaccagtaccgtgagggaaaggtgaaaagcaccccgggaggggagtgaaatagttcctgaaaccatgtgcctacaataagtcagagcgcgttaatgcgtgatggcgtgccttttgtagaatgaaccggcgagttatgatcccgtgcaaggttaagactaaaaagtcggagccgtagcgaaagcgagtctgaaatgggcgttttgagtacgaggttatagacccgaaaccaggtgacctatccatgtccaggttgaaggtgcggtaaaacgcactggaggaccgaacccgtgtaagttgaaaattgctgggatgaggtgtggatagcggtgaaattccaaacgaacttggagatagctggttctctccgaaatagctttagggctagcctcggaattaggatcatggaggtagagcactatttggactaggggcccgtcttgggttactgaattcagataaactccgaatgccattgattcatatccgggagtcagacgatgagtgataagatccaccgtcgaaaggggaacagcccagaccatcagttaaggtccctaaatgtatgctaagtggaaaaggatgtggagttgcatagacaactaggatgttggctcagaagcagccaccatttaaagagtgcgtaatagctcactagtcgagtgatcctgcgccgaaaatgtaccggggctaagcatactaccgaaaccatggatgcgaccattaggtcgcgtgataggagagcgttctaagggcggtgaagcaagatcgtgaggacttgtggagcgcttagaagtgagaatgccggtatgagtagcgaaagataggtgagaatcctatccaccgaatgactaaggtttcctggggaaggctcgtcctcccagggttagtcgggacctaagtcgaggccgagaggcgtagacgatggataacaggttgagattcctgtactagttaagtgcgtttgagcaatggagggacgcaggaggctaagatgtgcattctgttggattagaatgtccaagcagtaagtcttgtgaagagtcaaatgcttttcactttaaggacaagctgtgatggggagcgaaatttagtagcgaagcgtctgatgtcacactgccgagaaaagcttctagtgagtacttaactacccgtaccgcaaaccgacacaggtagtcgaggagagaatcctaaggtgagcgagtgaactctcgttaaggaactcggcaaaatgaccccgtaacttcgggagaaggggtgctgatcgcaagatcagccgcagtgaataggcccaggcgactgtttatcaaaaacacaggtctctgcaaaatcgtaagatgacgtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcactgtctcaacgagagactcggtgaaattatattgtccgtgaagatgcggactacccgcgacaggacggaaagaccccatggagctttactgtagcttgatattgagtgtttgtacagcttgtacaggataggtaggagccatagaaaccggaacgctagtttcggtggaggcgttggtgggatactaccctcgctgtatgaccactctaacccgcaccactaatcgtggtgggagacagtgtcaggtgggcagtttgactggggcggtcgcctcctaaaaagtaacggaggcgcccaaaggttccctcagaatggttggaaatcattcgcagagtgtaaaggcacaagggagcttgactgcgagacagacaggtcgagcagggacgaaagtcgggcttagtgatccggtggtaccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacatacctctggtgtaccagttgtgccgccaggcgcatcgctgggtagctacgtatggatgtgataaacgctgaaagcatctaagtgtgaaacacacctcgagatgagatttcccattcctttatggaagtaagacccctgaaagatgatcaggtagataggttagaagtggcagtgcggtgacgcatgaagcggactaatactaatcggtcgaggacttaaccaagtaattggtgttccggttcatatgaagatatttgatattgtctagttttgagagcacaagtttctcaatagtgtggtgacgatggcgagaaggatacacctgttcccatgtcgaacacagaagttagcagcgacgtcaaacgttccgagtagatcaccttgatgaacggtatcgcccttctgaacgttagtagtgaagtgttcaccatttaaattgaccgtatctaatcctaagtgaatcagaatttcggcaccagcagttgttttgatgccataagcatgatggctatcataagtgacagtgatgaccccgtcagctggtgcgacgacctgatcagcgcttggcacgattgcggcacctttacccatgatttcggctgagaaaacttggtcgttaacttgtttgagactttcactagtccccgttacgggtgcactgataatctcatcattaacattgatgacggtactcgttggtgctggtgattttacttgatcacgatcgtcaccgagcgttcgtttggcatagataaaagttggaataaatgcgacgacgaacgagatgacagcactgagcatgaatgctggaatcgactttgaagcaatcgaaatgaacccgatgactgatgcgggacccatcgccacggacagaacgtggaatagtcctaagaaagctgaagcaattcctgaggcaatcgctgcaaagacaaatggaaatttcatcttgaggttgaccccgaaaatagcaggttccgtaattccgagtaacgctgagaccccggctgaagaagtcagggctttttgcttttggctcttagtggcaaagaaaatagctaaagtggcggcaccttgcccaatgttggccatcgaggcgactgggaagataaaagaacctcccgttttggcgacgttagccaataactgggtttcaatagccgggaaggtttggtggagcccagtaatgacaatggccgagtagagaaggccaaagatgcccatgccaatccaaccagtcatgttatataagcctactaaaccgttagttaatgcgtcgctcaccgttcgtaagacaggaccgacgattgtgaaagttagaaagccagtgatgacaattgcaaacattggcgtgaacgtaaagtcaaatgcacccttgatatgtttgtggaagaacttctccaaagtagccaaaatataagcaacggccaaaacagggagcacttggccttgatagcctgcttgtgcaacgtgtaaaccaaagacgttccagtaaaccatcttgccggcagccatggtcgttgcaacgctatagccgttaactagtgatggtaagaccatgatcatgcccatcgtagcacccagataggggttgccaccgaagcgcttcgttgctgaaaatcctaagaggattggcaagaaagtaaacggcgcactagccatcgcgttaatcatttcggcgatacctttgaggccagggtaaacttcaacaactgacttcgccataaaaagatgctcggcagtcaaaacgttgtttagtgccattaatagacccccagcaactagtgcagggacgattggaataaaaatatcagataagactttgaggaagtccattaatggatttttcttttgacccgcagcggcaactgccttgatgtcatcgggtgtcgcttctttaagacctgttttggcgattaaggcgtcatagactttatcgacatcgccagggccaataatgatttggtattggccgttagtttcgaaggtccccttaacgtccgcgtcgtcatctaaggcttgttgatcaatcttggattcatccttgatgaccaaacggaggcgtgtcgcacagtgggcggcggcttgaatgttgtttttaccaattgcattaagtacgcggtcggcaacttcttgatgattcataataattcactccctgagtctaaaattatttttaataatgcaagcgctttacagacccaatgataacaagtctggaaaatatgtcaagcgtttgatacaaaattggattgcttgataatcttgctaaaaagccgaatttgaaacgctgacatgaaaatataatataaaaatgtcaaacgattgacatattggtgtaagcggttttataatggtgacaattaagtcgaacgttaaaaaggagctcatcgtcatgatatggaatcgtaaaacccgttataccccttatgaacagtggccagcaactaagctaccacagctcgttgcccaggcacgccagtctaagtggcggatgcaacatcatattcagcctacatcaggtttgttaaatgacccctgtggcttttcatactttgatggtcagtggcacctgttctaccaagtctttccgttcggtccggtacacggactgaagtcatggcaacacgtgacctctaagaacttggtggattggcatgatgagggcttagcgattcgaccagatacgccgtacgactcacacggcgcgtacacgggtacagcactaccaattgatgatcagttatttattatgtatacgggtaatgtccgtactgccgactggcaacgtgaatcgtatcaattaggtgcctggatggacacggataatcacattaaaaagctgtcccggccactaattgcgcatgctccggctgggtacacgagttcgtttcgtgatccggacttgatccggactgaccacggctactacgcgctaatcggtgcgcagacgactactgagatcggtgctatcttggtttatttctcaaaggatctgaccacctggacgtgtcaaggcgagttgaacgttcccgcaaatgcacggggttacatgattgagtgtccaaatctggtctggatcgatcaacagcccgtcttattgttctgtccccaagggttatcacaaacaacgaccccgtatcagaatatttatccgaacatgtacctagttgccgatcaattggatctggctcaggcacaattcactgaaccccacgccctgacgcaattcgagacgacccagcttgtgatcgatacgatgaagcaagctctaaaagcaactcatggtatcaaacctgagattttacactctgaccagggctcagcctacacatcaggtgcatacaacacgttactagctggggaaggcatcgtgcacagtatgtctcgtcctggaactccaggagataacagtccgatggagagcttctggagccaatttaagaccgaggagttggcattcaaacaaccgctctccgaaattgagctcattaacatcatcacgaagtacatcaattggcataacacggcgagacgccaattgacactaaacggcatgaccccggaagaataccggaatcatgccgttcaagaaagtgcataagattttaattatttaattgtctacttgacacggagcagctccacacgcctacgtccacaaatcaatcactatattaaagatttaccagataatgaatatctttttaccaatcgacaacatcagccgctaagtgttaatgccgtttataaacttttccaaaccatcgcccgtaaaatgcaccgaaccgatatcggtacccatacactccgtaaaacttttggctaccattattatcagcaaacccacgatattggaactttgatgatgattttcaatcattctagtgaagcaattacaaaacggtatattgggctcaatcaggatgttattttgaagcagatggctgggttttcattagggattgatactcaaaataaagacacctcccctaatcaaaagactggttaaactattacgattagtttaaccagtcttttttataatgatatcagacaaacccattatttattgattgttacgagcataggtcatctcaactttatttttatccatctgccaccaatcttggtgatccacataccaattaatggtctcctgcaatccagattgaaaatcagtgtatagcggttgccatcccaattcatcacgaatctttgatgcatcaattgcataacgtaaatcgtgaccaggacggtctttaacaatatcatatgcattttggggttgcttcattaactttagaatcatttctaaaacagctttattactcatttcaccgtttgcaccgattaaatatgtttcaccaatttttcctttagttaaaatatcccaaatagccgcagaatgatcgttcacatgaatccaatcacgtatattactaccactcccatataattttgggcgtcgtccgctcagaatattagtaatttgacgtggaataaatttctcaatatgttgatatgggccataattatttgaacaattcgagattgtcgcctgcaagccaaatgacctaatccaggctctaactaacatatcactacttgccttagaggcagagtacggactagacggccgatactgactatctggagtaaacttttcattatccatatctaggggtaaatcgccataaacttcatcagttgaaacatgatgaaatcgtttattatacttagttgccgcctgaattagcgtatatgtgccaacaatattagtctgcataaatgaccacggattaactagtgaattatcattatgactttcggccgcaaaatgaataattgcatccgactgatgcactagcttattaaccaacgggacatcacaaatatctccgacaaccagttcaacatgctttcctaatatatcaacaagatttctaaagtttcctgcataagttaacttgtctaaaatcaaaattctaatttctggatgtagctcagctacataatgagcaaaattagaaccgataaaacccgcaccacctgttataagtatacatttcatactttaaaatcctccataatattttagctgttgtagcaaaaaacattctcaccataacatagtaagaatgcctttattaaaatgcatatttcaaaaacctcggaaattttttttcaaatgaatttaaaatcaaaaatagaataaatgtaccagccactgtcaataacgccaaaaaatattgattgatatttaaattaagcttcatacaaaaaaactttatactaaaaataaaaataaattgtgaaaggtatgtcactgtacttgctttcctacatattttagcaaacgacaatttcacttgaaacttcaggcataaaactaccaaaaggaatgataatggaaacagcataaaatactgatccgtactacccgctgcatatggtaaattgtaatgaattgccacgtttgcctcgacaatcgaacaaattaacgcaagaactgtgatacttatcaaaacaggctttgaaacatgtaccatccagaaatgacggtgatcaaaaagcaccattcccaatgaaaaaaagaacagtcccgcaaacaaactatttgctggcgaaaataatgctcgtagctgggctatgggtcccatttttcttatcaatgaaccatacgtgctggaaaatacgcttattaagaaaaacggaagtgtataaaataacaaactaagactgctgtgcttaaagtacaatcgcccgagtatagccgcagaaaacatcgacgtagtcaagtaccaacttataccataaccagggactgcattatatacacaagacagaacaaacagtaatgaagttttccagataccaaaggtagatgaacgaaaataattcacactattatatagtataaacggactgttcagtatcatccaaaataaataaagtcggaagattcgagcaacatattgaataatcaacctattcctgtccccttcatcatttttgcttaacttatttgtataaaaataagccgaaacaatcaaaaaaaacggaaggccatttcataagggacagatcattagaattacatataatcctaaatttggtgtgactaattataaaaaagttagccgtgatcaggttccaccattggctagaattcactaactttcctaaataagaatgctgttaaattagcctttcatcttatcgcttcacctagaccaatttgaattcacaaagtaaagaataagtacccccgctaacacagtgttagtgggggtactttgattaatggcgattatgttaagttcatatatgactactatgatttgttagctaaaatataatattgctatacctgtaccaataaaaaagagatctaaaatcactgtaagtgcgatagttattattttacctactttgttgtaagggttaacacttataccatagccaaaagctttcggcacccatagtggaggatttggcattccttcataattttgataaacaaccttaccgaatttgacagcaacatgaattaaaatgatagacagcattaaaataaatactgtaacaaactttgttaagcttttattgctagttactaaaggtataattactactgccataagtacaataagcacagtcaatacaatcaataagacagaatacttcttattagcctttttcgtgttaatcaattcataatccttttgtactttattcatcaattctgtatctcctttgatgatatccaaagaaaagttataatagttgcttaattctataagcatgggaatatctggaaaattttttccattttcccaatttgacaaagattgcctagtgataaagagattatctgcaactttttgctgtgtttcatcttttttctttcgttgtttaactaaaatagtagatagttccatatttgttcccttcctacgccattatattactttgacaacaaatttatttctagcaaatatttcttgcattgttcatttagaaatgataacaagggcaatcagtttgatttgagcagagaaagccctaagtgtttaggacttttgaaaattgttcaaggtataattcagaatcatatcgcttgtatcaaccacgtatatcgttctatttgctcttctatcgtctgcccaatagaaaaccttcctaaggctaaaacacgtcagacacttaaattgctttttatgcagtttaaaccatatagtgtgctaattctatatgccacttctttgccaatcacttgcgggtgagcctacccataatcgaattgttcattttcctaaaataatttcaaaaattttcatttttaaaactcctttttagcaaactttatcacaatagttatcgatttacaggtctatttttgtcgttatgatttagttaagtcccataagggtgcacttacacttcaaataaattggagttgtgctaaaacacttaaacctgtatcagatttcgctttgctcaaacaaaactgacttgcgtcagttggaatcttcaaagccgataaagtccagtcgccaactcctccagactttatcggctttgaagattgcttttaaatacctctaatttgctctctaagccattttagctgttacccgtataatttcactgtccgtcaacggtaaatcgacgtagaacggcttttagccgttctgggaggctttaaggagttgacggactcgctaggccaagacacttttgcgcatgcaaagaaaagcatacctgcttttctttgcatgcctcacggcgagtgcggggtgagtttgagcgggagctcccgctcatttatggggtcaagctgacacagcttgcaggtttgggcagcgcccatggttttattcgtgcgggataggaatttggaaatcaggggggcgagggagcgaattttgcgaccgtactacgactggatttctgtctcccctaaagtatttaaaagtatgtattcaaagtattatattaacgcgcgcgagaaaaaaattgcacttgaggtacggttaggggacgtaacgtcgtccccaatcccccctcactcaaaaaggagtgagcgaatcccacgctcacatctaactgcgcctcccgtgggtcgttgctaaggtcaaaatcaagcccacggttaggaagacttcgggcacgccctcaggcagagttaacaacggctagtatcagaactagtccttactattcctttactgattaacaattgtcttatagctattgatcatcagtaaaagtaaaattgagatatttttatcgaaaatgagtattatttgattatgataaaaagcaatcgactaaccagtttaggagaatactcaatgaaattactaaaaagaatctgttctgactacttgcatggactagtatttttcataatagtattttactttatgacggctaatccagatggcagtatgcctctaaaatggagtattgttaacgtctattggactatttcctttctgatcgcatacccattactgttagagacggtgcccagtattaaaaaaatcaatttccatatgaagtctctgcaatcacggtcaattcatatggaagataaggccacaaaaaaactgtctgatttgtaccatgattcaactaatccagttagcaaccgaatagatttacaagctcgcagtgattatcaaaatgactggcttaatttaataattagtttttttgttagcggactccttatcgccatttcaataccaagtttgttttttattgcttttaaaaaccttttagggagacgaatgttatgaaaaaactttcacttatggtagattgtaaaattaatccgaacgcccatttggatattggacagccctagttcacaaaatagatccttgattatgatttaggaggagtgagatttgagctttaaagatgatgttaaaatgttacgcaggcaatctaacttaacccaagaagcgttagctcaaaaattacatgtgacccgtcaaacggtctcaacttgggaaactggcaagaatatgccaagtttagagaccctgcatgctttgagtcaattgtttaacatctcactcgaaaaacttctatttaacaaggagattgcaatgaaaaaagataaagaaccctctttggctacccagatagatcatgatgttaagcttaaaagtcgttatcgtcgttggacttttggtttaggtggcttgatcgtactagcactggttagtattggtattttatgtttgggatattataaaggtattgggacgattgatcgctttgatccgtttttatcctataaagtcgggtacactaaattacctagtgaaaaggaaatttctcctaacaataaggcgaccaatggttactggaccgcttggttcaccgataatacgatgggtaatgaatggaccaaattaaccttaacgacggggcttaatcctggggtcaaagatccttatgtgatggcgtatcataagggcagctatgttaaagttgcacgtattgtgcctcgcacctacattaatcagacttatgttagcaacttagcagcgctagatgccttgttaaaccataagggaaatacagcgactaacaatcatgaccttaagaagtataagacacaaatccacatatccgacactatccaacagttagtaactgaatagagaaccaccaaattacaatccccaaagcagctttagggtctataaatctaaataaccattttgtactaaatactttttaaatagtctttcaaagcggcattgttatcgctttgaaagactatttttgtcaaatttggagtcaaattaaatcggtcaacacataaaaaataatgtcttttgtttacatttattataaataatgttaacttaaaataaacattatttaattaagaaggggagaaatatgaactggtttttaacactagatcaagcggaccaagaatttgttaaacagttagtatatgcttcgggctctctaaagcaattggcaaaggtatatcaagtaagttatcccactgttcgagctcgtttaaataatgttattaacaagataacattacttgaagataagaaaaaagacagttttgaaaccaaactcatgcaattagttattgatgaaaaggtttctttagacgtagcaaaagatttaattaaagattatcaggaggctaaaaatgagtgatgtaatttcgtatggaagcagtttattaattgcggttgtcatctattggacagatagactttttccaaaatggtttggtggagtttacgacttagcatttttaatttttatggtttacgtcatgattaccagaggacagggcaatttgatttctatgtttttagtattagtcataggcgaagctgttattagtagtttttggttatgggcccgtgaggataagaaaaagaaacaacaaaaagaattagataaaatgaaagctaaggatatatcacgaaaaaaataacactttttagggcctacaatcttcaaataacacctataacaagagtaacaccgaatcattacttactcttgttgcgtttcatattttaaaactacactattgttagctgttgtcatattgattggaatttttgttaaaacatactttttggggtaggtagttgcttatgaagactattatcttggcttgaggtgatggcattttttatacactttagcagctttgctcctaccagtggggtctataagttccaaatagaccctcaaaatcattgttaaaataacccccaatatctataatgtagatgttggggctatttgtttttatatggcataaatgacttctcttattcgtcatttttttgataccttttggaacgattttgaccaggaaataaacgatcatgcgatccgactcgaatgccaattaagactagttcatctttatcaatcgtataaaccaccaggacatcgttagtttcgcttggtgttttgtttttcggggtatctcgtaagtgaaattcattataaccgctcattcgccgattaagctcatgatcttcaaattctgatggtaattgttgttgctcaagcaacaggtcaatggctgctcgaacttcatcaataatagatttgtctaaactggctaaccgttttagatcagcattaaaggttgcacgtggtttaaatcttagttttttcattatttaaacatggctgaaaataaaaaaagagtttcgattgggttaacagacaaacagtatgaattagttgaaaagttggctaaagaaaagggcttttcaaagtccgcaatatttgttttagctttagaagaatattcgagaaaggaatcagagcaaaaaaataagtgagaactcattcccttcaagaaatacgagttcccactaatgcttgttctgtcaaggtgattataacaaatggcaaaagaaaaggcgagatacttcacttttttactttatccagaatcgataccacaagattggcaaacaaaacttgaagctttaggcgttccaattgcaattagtccgcttcatgacaaagatttgagcagtgtcgaggggcagaagtataaaaaagcccattatcacgttatttatatctctaaaaatcctgttacagcagaaagcgttcgtttgaaaattaagcgcgctttaggcgataagagcgttgctaaagtacaaattgttgttcagagtatggaaaatatgtatttgtatctgacacatgaatctaaagacgctattgctaaaaataagcacaagtacagcaagcgcgacattactttgctgaacaattttgatattgatcgctatattacgcttgatgttgaagacaaagacgacatgctgaatgatgtttgcgatttgattgatgaccataatttggcaaatatgcgtgaactgagacgctttttaaaagctcatggttcagaatatggcatgcccggtattaaagtcgtcaattcggttttacgtgctcatactggactgataaggctgtatttcgatgctgtttatcaggaacgcaagtacggcagaggcgatataaacaaagagaccggtgagatacaagactaattagcaaatggaaaatgggtgctcaaatcgagcacccatttttgttgtcggctagccgacttctgatacagggaatttagcacaaacaccagcaattttaattgtggtgtgtaagtgcgcatttattttgctttacaaaatttacagacggtttaatttagtgattgtttataaaaccagtaataaatccaaaaagcataggtaaaataagaccaaggcataaaaggataaagcccaagcgacaccatatatttaactttggatataaatccttgaaattaaacaacataattatcagacctaaaaaagcaataaaatatcctgatgtataaatcattttgaatctcccttcaaccagtcatgtactttttactcacctattatgctcataaacgttgatataaagccaacctcatttctccaaataaattggagttgtgctaaaacacttaaacctgtatcagatttcactttgctcaaacaaaactgacttgcgtcagttggaatcttcaaagccaataaagtccagtcaccaactccttcggactttattggctttgaagattggttttaaatgcccctaatttgctctctaagccattttagctgttaaccgtataatttactgtctgtcaacggtaaatcgacgtagaacggcttttagccgttctaggaggctttaaggagttgacagactcactagaccaagacacttttgcgcatgcaaagaaaagcacacctgcttttcttgcctgcctcacggcgagtgcggggtgagtttgagcgggagctcccgctcatttatggggtcaagctgacacagcttgcaggtttgggcagcgcccatggttttattcgtgtgggatggaaatttgaaaatcaggggggcaagggagcgaattttgcgaccgtactacgaccccccttttaagtgccgagtgccaaaattgaattttagggggtctcgggcttactcctccaagggatacagcgattaaaaaaaaatcaacaaatcgccaacaaaattgccaaaaaaacgcgtgtatgtaaaaaagtttgacaaaaaaagcaaataaaagtaaaattaatttacaatatttagaaggagtatgttattaatttctttagtaaaagaacttcaccattgcaaagctagtaaactatgctaagataattttaactattaggtacagaaagggccgcatcttcggatgcgaccctttcgttgtttttgcatttcaactaaccgtcatagcgctttagcattcgctatataacgttactttcgtcctgctgaccaatcaatggccggctgttcagccaaaatctgatcaatctccgctaattcagcttcactaaatgctaattggtccaaagccgccacattgtcaacaacctgttgtggccgactagcgccaatcaacacgctagccaaggcgggctcacgtaagttccacgctaaagccatctgcgccaagctctgcccacgttgttgtgcgacctcattgagccgtttaacggtcgtgagggtctgttcaacttggaccgggctgaggaatggtattgtggctttattcgctctggagttcgctgcgatgccatgcaagtatttgtctgttaatagtccttgcgatagtgagctgaacccaaccgccgctttgtgtgtcttctccagtaccgggaacaaatcttgttcggcctgacgattgaacatattatagcgtggctgatgaataatatacggcgttccgagctgctcaaacagtttggtcatcgccgccgtctgttccccattatagttggaaatcccaacgtagagtgtcttgccctgacgaactaattggtcgagggccgctgcagtctcagccatcggcgtttcaggatcaggacgatggctgtagaagatatcaaaatagtctagtcccgtgcgttgtaggctctggtcagcactggcaatgatactcttacgtgacccccaattgccgtatggtcctggccacatgacgtagcccgctttactggcaatcaccatctcatcacggtacggccgcatgtcggtcttcataatttgaccaaagttggtctccgaacttcctggttccgggccatagttgttggccaaatcataataagtaatccccagatcaaaggcttgatgaatgatcgccttttgattggcaattgggtcaacactaccaaaattattccataatccgagcccaatcgctgatagcttaaggccactctgccccactcgattgtattgcatctgatcataacgcgtctgacttgcctgatacattttaaacaccccttcattgttactccttgctaaagttaccgctttcattagtaaaaagcaactgccttttttactagcgtcgttggcgttcacaaggcaacatttctgctcacttttgaaccgtctcgcttgataaaattaatatatgaactagaatatattataatgatataatatcgaaggagactcattatggaccctaaatttcttgaagtaatcaaagacaccacccccgcaaccattgttaccgtcaacggtcagccagcccacgtcgttaatacgtggagccattacatgcagctagtcgacgaccataccttattgattccatcagctggtatgcactcaattgaagccgacttcgcgaaggataaccatctgaccatcgctgtgggtagttacaaagtgccaggcacaactggaactggctgcggcttccatattcacggcaccggtaagtttgagactagtggcgcttacttcgatcagatgcacgctaagttcgactggattcgggctactttggttgtgacgattgaggatgtggaacagaagatttaatatattcaaaagaatcctcgtatatttaatataaacaaacaattttagaccattttatagtttggacgttacgtgctatcctctagttgttcattggatctgggtccaactggtataggtttctccctcccgtagctagttattctagactacatgttaagtctgccgcccaggtgaaatcgttcattacaaaccacaagccgttggtcgctaacttttggtagtgactcgcataccactacgcagctcaaaggctagcgataacttctaatattgcgaggctgtattcacggtttcattaactaagggataacacgcagcgcccaagcttagaccaattaatctgacaagaaaggaggtccgatcctatgaacttgaatgttggtattgatgttgccaaaactaaacttgattactgtggtttgaatagtgatcatcagattttgtttcaagccgaagttcctaaccagcctagtggtgtcaaggcaattaagacggccattttggcggctaaccactcacagaaatttgataagatcatcattggtatggaagcgacgtcagtttataacgtcctgccaagctatgaatttaatcaggacgctgacttacaagcgctagatgttcaggtggtgacacttaatccaaagatgacgtcccggttcagcaaggtttacgatgacgaaaagactgatcagattgatgccaaaaacattgccgaatttgtcttgttaggtcgttatcagattcccgttccccgtgatgaaaaacacttagcattacagcgtttgacccgcgaacggtatcacgtggtaaaacagatcaccgatagtaagaatcactttctgaacaacttgtactttaaactgaacacaatcgacaccgaactgcctacctcggtatttggtaaggctatgatgagcttcttaactgatgagcgttattcgctagacgaagttgccaccttacctttagatgaactagtgaccgagttaaaccggctcagccacggtcgcttcggtaatcccgaagcgattgccaaggcgcttaagcgcgctattcaaagttcgtatcggctagacaaagtcgttctagattccgttcatgaagttctcggcatgtacgccaacgagatccgcatgtatcaacagcaattaaaactactagataagcacattacggatctttgtcagacgttaaccgaagctaagtgtctacaaagtattcctggcgtaggcccggtctatagtgccggtatcatcgcggaaattggtcaaaacgatcgttttaccaagcaaaccaaaatcgctaagtacgccggactcgcatggccccgccatcaatccggcaatactgaacgtcaagcaaccccgcgcactcagacaggtgatcaatatctgcggtattacttaattgaagctgccaattcaataagactgcatgatcccgtctttgcacaatattataaaaagaagtatcaggaggtgcccaaatatcaacacaagcgtgctagtgtcttaacggcccgcaagttagtccgtgtgattttcacacttttaaaagaacacgaactgtatcaacctgcgaaaatggtctagtgcgaaagacaaatctaaaagtgttaaatccccaccgctaaaaatcaaacaaccgtgggttgggggaagtatacactcgtttgaccaagatacgctcaagtatcaccgcctttttccttgactattcaccacaagacttgtgtaggtttccgtaatattccttagaaaggaggtgatccagccgcaggttctcctacggctaccttgttacgacttcaccctaatcatctgtcccaccttaggcggctggttcctaaaaggttaccccaccgactttgggtgttacaaactctcatggtgtgacgggcggtgtgtacaaggcccgggaacgtattcaccgcggcatgctgatccgcgattactagcgattccgacttcatgtaggcgagttgcagcctacaatccgaactgagaatggctttaagagattagcttactctcgcgagttcgcaactcgttgtaccatccattgtagcacgtgtgtagcccaggtcataaggggcatgatgatttgacgtcatccccaccttcctccggtttgtcaccggcagtctcaccagagtgcccaacttaatgctggcaactgataataagggttgcgctcgttgcgggacttaacccaacatctcacgacacgagctgacgacaaccatgcaccacctgtatccatgtccccgaagggaacgtctaatctcttagatttgcatagtatgtcaagacctggtaaggttcttcgcgtagcttcgaattaaaccacatgctccaccgcttgtgcgggcccccgtcaattcctttgagtttcagccttgcggccgtactccccaggcggaatgcttaatgcgttagctgcagcactgaagggcggaaaccctccaacacttagcattcatcgtttacggtatggactaccagggtatctaatcctgtttgctacccatactttcgagcctcagcgtcagttacagaccagacagccgccttcgccactggtgttcttccatatatctacgcatttcaccgctacacatggagttccactgtcctcttctgcactcaagtttcccagtttccgatgcacttcttcggttgagccgaaggctttcacatcagacttaaaaaaccgcctgcgctcgctttacgcccaataaatccggacaacgcttgccacctacgtattaccgcggctgctggcacgtagttagccgtggctttctggttaaataccgtcaatacctgaacagttactctcagatatgttcttctttaacaacagagttttacgagccgaaacccttcttcactcacgcggcgttgctccatcagactttcgtccattgtggaagattccctactgctgcctcccgtaggagtttgggccgtgtctcagtcccaatgtggccgattaccctctcaggtcggctacgtatcattgccatggtgagccgttacctcaccatctagctaatacgccgcgggaccatccaaaagtgatagccgaagccatctttcaaactcggaccatgcggtccaagttgttatgcggtattagcatctgtttccaggtgttatcccccgcttctgggcaggtttcccacgtgttactcaccagttcgccactcactcaaatgtaaatcatgatgcaagcaccaatcaataccagagttcgttcgacttgcatgtattaggcacgccgccagcgttcgtcctgagccaggatcaaactctcaaattaatgatgagttctaaaaagctcatttaatgttgtactaaaatttatttgctagcgaattgacttcgcaaatgtttatatgcagcaattacattactaatcaataaacgaaaaaaataacgcactttagggtctataactatcaaataacccctcaaaaacattgttaaaataacccccaatatctataatgtagatattgggggctattttgtttcttttatcaataaataacatctgcttttcagaaaaattgttggacctttgtactaatcgaactaatttcttgctgagataaagtggccacaacttcgccatctgatcgttttgttggatcgacagcacggacatgttgcaataacgctgtcccgtgaattttcccgttatctatcctgataaataacggcgatttagcatacttttcttgggtacgatatttgtcagaggtactgattggcacaactagcaccgtattaaaatagcgattatagtgatcgttgcttacaactaaacacggtcgctttttcttagtttcagtgcctttagccggatctaaattaatccataaaatagcgccttgttttaatttcattaatcaaagtcttcgctttctacgtctttaccccaatcaacttctgttgtactgagatttccaaactttttttcttgttcatcaacaagttgccatagatccggtttactacgaacaatcattactttaccatttggttcaatctgccattcaattgtgtcagtagaccgaacttttaacagttcacgtactgttttaggaattgtaatctgatttttacttgtgatcttcgagctaaccttagttacattacctgcgctcacaatatcatctccttactttttccttacaaaaataataacataactgctttaatatctcaagaaaaggagaaagactatgcaacaagttgttttacccatcaaagattcaaacgttcttaaagaggttcaagatacgttactcaataactttaaagctggccgacgtaactatacagtttttcaagttggcaaagctacgctactgcgagtgagtgatgtcatgcgcttaaaacaaaccgatatttttaatccggacggttctattaaacaaaatgcgttcattcacgaccgaaaaacgggtaagcctaataccttgtatcttaaaccagttcaaacagagctcttattgtaccgtcaatggctacttgatcatagactagcctctgaatggctctttccttcaactcaacacccagaacgccatattactgaaaaacagttctacaaaattatgagtaaggttggcgatctattaggaattaattatctaggtactcatacgatgcgcaaaactggggcttatcgtgtttacacgcaatcaaattacaatattggcctagtcatgcacttactaaatcactcaagtgaatcaatgactttagcttatttaggcttggatcaagcaagtacagaaaacatgttgaaccaaattgattttgggtaaattagtttgattttgttgtcgccaacggcgacttctgatacaggtttttaatgggtctagcacaacatagaataaattctatgtgtaagtgcgcattgacctcgtttcactcggtctgctgataaccatgaaatcagtttttgccgttgttgaattgactgtatttttaattcaatttatgttgccaacgcgttcgcataggcgagcgtattggttgctgggacgattgggtcatcagcggtcgtccagataaaggtcggctgattatccgaattgacgtgctggtcagcagctagttcggccggagttgaagtccaggtcgctaaagtcgcatcatctttggggaaacctagtagcggactgataaccggatagctgaggatcacgttattcggtttcaacgtagcgggcgctacttctagttcggtcgccacgcgacttgaccagtaatcgttatatagggccacgatatggccacccacactaaaaccagcgggtgtgatctgttgcggatcaatatgccattcggctgcgtgttgacggagtaagttgaccgctcgtcctaaatctagtacgggcgctaatccgagcggctgctgattagtgagtagggtatattccaagaaaaaggcctggtagccgtggccggcgaaagccatggcgagactctcggcttgcgctacaggaatatgcgtgtatgaaccgcccgggacgataataatggcgggtaggttcgtttgatgtgcgttcgtatccggctgatgcaaataaccggtcaattgcgcgcacgttgcggttaatttttgttgaataacttgcatgcaatcacctcaatttgatatggttaacataactattataacgcaagtcaggtggaacagatatgggcatggttacggttacaactcgtaatgagcaactcgagttacggccatttacgttggcagatacagcggactattatgatttagttcgcgacccgtcaattgcggcatcagcgggcttcacgccagcacacagcttaatggaagcggagtttttgttgaaacagcaagcgaagctaccacagatttttgcgattgagttgacgacgatccaccacgtgattgggagtgtgggcttatatgagcgcatgactaatactggtgaaccggccactttagagatggatctcgggtatatgttgaacgctcgatattgggggcgtggtattatgacagcggcagttgcgcgccttttacaatatggatttgagacgcttcatttgcggcgaatcacggccagctgcctggccaataatccagcgtccaagcgaatcttagaacatgccaattttcgacagtatgatgcggttcgtcatccggattacgccccgtttggcgctggtcagacggagttattctttgattgtgtggaattaaatctttaggagatgagttaatgcaactcgcaaaatcgtttgaacaggccgcctgtgtgttagtattgttggccacgcagcaattttttacagaatatatcgagcaagttttcagaaagaacgttgaacctaacgttagccaaaattgcttgactttatcggttttaacggacactcatgaaaaagctgttgccagttcatcgtactatggtctcaacggtgtaaggcatattattgaagccaataaggcttgcgattcattgccagtggattacaatattcatttaggcgatttgatcgacggtagtgataagccagagatcagtcgaggattgttacaattcacgatggaaaattaccaaaatagccagcgtcctttttatgtgctggaaggtaatcacgatgaaaatgataagtatgatgaacacaaatttattacttcagcctcatttagacgtgacgactactataatttggtaacgaaacatgatttcgaacaacctgagattaaacacttgagtcttggttccaaagttgcttggatcgataaaggggatattcgagtaattttcttgaatacgagcgatattccctatatcctaaatggcgggaccaagaagtacgacttcaaaaaagtccgtggtatccgcgagcatcagatcgaagatttaatatctattttagaaaagacaattgataagcatatcgtagtttttggtcatgctaatttgatcagtcaaagtggtcgttcagctttgaacttcaacggtgacttagttcagaagatttttactagctttaataataaggattctggacaacttaaaaatgaattatccggtgattttggagttaatgttcgctataactttactgataccggtatttcgaccatattgaattatatttgtggacacacgcattatgaaaaatactacaaagttaatggggttaatcatataacattaaattgttcggccttaatgggtaaaaaacatggcctaacgactgattataataaaaaatgggatcgccgatataatgagatttccgaattagctggatatttcattaatatcaatcccgacaaaatgttgctccaaatatttggatatggtgcagcaaccagattcgtaagttttgaaatttaaggagaattaatatgtgcggtatcgtcggtttcgtagacaagaagattgctgacaaaaagccagttatagaagctatgatgaatacgatcaaacatcgtggtccaaatagttcgggggaattagttaatgaggatacggcgctaggatttcgtcgattgagtatcattgatatcaacagtggtatgcaacctatttacaatgaagataaatcaaaagcagtaatttttacccgaattgtcaaatcaagtgcaacacttacaacctattcttaaacagtggtctagttaatcaaagtctggcaggacatccttagctgattgatagccgagaattcgccgtggtcgttgattcaaagcatcttgaatcgcttgaattccggtgatggtcaaggaccgcatcgaccgtcctttgggaatgaactcgcgaatcaactggttttggttttcattggatccccgttcccagggtgagtatgggtgggcgaaatagaccgttgtaccagtcacttgggacaggttcgcaaactccgagccattgtcaaaggtcacggttttgaagtgttctggaccgtagtcgtcaatgatgtcttgaagcgcttgacgacaggtctcagcgtggtagtccttaatcttcacaataatttcgtagcgactagcccgttcagtcaaagtcatgatggctggttcactggcaactcgcttacccttgactaaatcgccttcccaatggccgacttccatacgaccattcaccgcggttggccggtcttcgatggactggcctaaagagcgcttattcatgcgctggtgggtcttatgggccgactttatccgtcggcgtaacttcatcgggagctcactattagtcagttctaaccggccttcgtcaatgtaacggtaaaccgtgggtgtcgaaggacacggtaatttggatcgatgcatcttaaaccagtggacaaaagagtcgatactgtggacgcgcggtttacggcgtaattcaatcaccaactgacggaaaaattcgggagcctttagtaaccaactgaccgcgtggcaagccgcacggtggttatcataaacaacttgggcggtctcagcaaaataggccataaaaggcttatggttagcaccgatttgccggattgtcccgcgtttcagttcacgactgatggtactagggttgcgatgaagttcgcgggcgattcgccggcaagaccagccgtcagattgccgggccataatcaggccacgttcgtaaggttggagttgttggtagtgacaagtaatggtattctggttatgggtcatgaagacatccctttcttagttcgtggttgatttaagaataggtcttcatgacctttttggtctagttttttaggtgttgcacttagattttaaatccgggagtttattaaagggaggcaccgctatcaagcgggcttcactagtgggcggacataatggaggcaatagctatgaatagcgatatcgagattattaaggggcggttaaccttattgtttaagcggcgtccccaaacccgctattggttaatgttgactaatgacacctacgatcagacctataatttgtttttcaacagtcaacgggctaatgagcgcttgcaatctgttcccttacataaattagctcactatgatttagctggtttagaaaaattactaaaagcattacgacaagatataaagctaacgattgaatttgtcggctttactggggaacggtggcctgcaagccaaaagctgattcaacgaaagcgggtgccacttgaataatcaagaatttgatttagccacggttaagcatttttttgaacatgattaccatgaccggggcatgaggaaatggcagggcttctatttatccgatcatactgccgcattaaaccaacagaaccagcagttgaatgcagtatacgttccacgaccgcaacaatccttagcaacaattaccgaggtattggcggacgcatatcagcgtcagcaaccagtgaccattcaattaaaaacggttgaccaaaacaaccgccatttaccagatatcaccaccttgatccatggctacaatgcaaatgatattgtgattaatgctgatcggtttatcccactaccagaaattcgcaatgtggcatacaaaaatacggaaaagctataaaattctagctctccgtatttttctgggtctagaatttttggtgttggaaaatatttccattccaaaagtactaggccctttttgataacaaaaaaaggcatctaagcctccctagtgctatgctttaagcgacgaaactcaagataagcggggtaggaatagatgtctcaactagataatacacttaaattactgggaattacagacacaaacattcaggtgttcggtactcgtgaggaatttcatggtcggggctcgggtcgcaaaaagtatttggtcatccagacagagcttacctacacactcaggcgctgtcccaattaatccgaacgctgttcggacaaaaaagatcagcttcccttagaatggtgtttaccacaaacccattttctaggagctgatcttttgtctagtataacctattctgaacgaattaaaattgaaaccttttgtgaactaggactggccaatgcccaaatggctgagcggttaaaacgatcgccgtccacgatttcttatgaattatctcgctgtcaaccttatcaagctgagttggcgcaggcgaacgctgaatctaagcgggcacgatgtggacggaaaactaaattgaatgccaaattaaagcaaataattctaaaccatttacgtctaagctggtcaccagaagtgattgctcatgaacttaaactagcgactaaatctatttacagttggttatatcagggaaaatttgaattctctttgagtgaactacctgaacatggtctacgccaacggcgtaaccttgaccaacgttctaaatataatcaatcattaggacggtcaattgaacaacgcccaatcgtgattaaccaacgtaaccgcatcggtgatttcgaaatagatacggtggttggccctcgcgggcatagtaaggccgttttattaactttacttgatcgtaagtcacgttttctttgggcctatcaatttaaaagatcggacggcagcagctgttaatgaagccctaatgaagtttctagtaacttttagagggccagtacacagctttactgtcgattgcggccctgagtttagcaatctagtgtcatttgaatcacaatacggtattccgacctattactgccatgcttacacgccagctgaacgcggcagtaatgaacgatttaatcggaacttacgttatttttaccctaaggggacttgttttgtgcacattagtgctcaagatttaacaacgacgttactccaaattaatcagagaccccttaaagtactcaactggcaaacaccttaccaggtgatgttgaccaatttgtcaaaaaattcggattaaatttgcaatctaccaatgcgataatctcttggtcatttaaatcgttcaaatcagttcctttggggaaatattcacgaattaaaccgttagtattttcattggttccacgttgttgtggtgcgtgtggatctggaaaaaataccggtatttctaaagtgtcaatgacgtcttgataattggcaaactcagttccacgatcaggtgtaagtgtctttacccgttccggtgtgacgctatttaataagtccatcatagcttgtgccacgggtttagctgcgactttacttacccgttccgctaataaataccgtgatttacggtctaccagcgtcaccagcgctgaacgtccggttttaccacgcactgtgtcaccttcccagtgaccaaaccgagttctattttcagccgaaagtgggcggtcgtggattgaaggtacatcgttaaaacgaccacgccgttccttgatagttcccttaactttgcgcgttttacctcgatgtcttaattggcgggcgaatccacgggcaccatgacttttacgcttttcaccaagattattcaaagcaattccacgataaattgtgttgtaactgattttccagttactatgctcaaaatttagccgtcctgcgatttgttctggggaccatttacgatggacgatacaattaatgacaaatgcccggatatcagtttgcgataagatccgtggccgtcgacttttcaaacgctgacgctcataatttagttgcgcattaactgcggaatatttagaacgaccaccattccggctaacttcccgtgaaatagtcgctttagaacaaccgatgcgttgggcaatggcctggtaagactgttttaaagttagcccaactagtaggcattcacggtcatttaaggtaagatgatgatataggctcatagtctgagtcctccttgtaagtaagttgtggtgactatattttacaaggactcaggctgtgagtcttctttttgatcatttgttgcacttcaattgtaaattcgtcatatctgaaaagatgacgccaattaagcgcgtattctttccttgcagtgagcgtgccatattattcggctgataatgcagttctcgcatcgccgcgaaaactttttctttagtctgactactcaggtagccatggttattaataacccgagaaacggttgtcgctgagacccccgctagcttcgcaacatcatttaattttggtttcattgttatcgactccagtatgctctgattggtgccattcccagactttaccggtaactgccgtagtgtcaccttgaacgttaaggcgactcggggtagcgtttaagaagaaacggccggtcatcacggaatagccattatcaatatagcattcaaagactgacacatctatgattagccggatttttatcgtcttatgggccgttaactccacttgacgagtctgaccataatcttcagcaaacgaattccccgtatgccgccgatcaatcataacctgaccatggttggcatcaacagtcacccgcagctggccactttcctgctgatcagcaatgttaaccgtgaccgttttatcagcgggaaccgtcagtaagagttcaaagctgccattcaaagcggccaccgtcgcccgttgttgctcaaagactaggtcatgcgccgtcgtccgcaaatcatccaccgctgccactggattttgatagaggtgcccatctttaagcgttagttccttaactaagctcaaacaatgggcccaattttcacgatcagttggataggcaatttcaggtaacccaatccagctgacggctaacgcgcggccatccggcgcattgattgcctgcgtggcatacacgtcaaagccgtcatccagtattcgcaggaaggctaagctaatcatcatcttactggtgttcagctttcgctcacaattgcgccagaggcgccgatattttcctagccagctaaaactgcgttcgataacccagcgttgcggggtcacttgaccgtgcctaaggtcactctgtttagcaataatgacttcagcgttaatcattgcctgaactgattgagcaaagttgttaccagtataaccaccatcggccattactcgttgaaccaggtcaaactgtgatttgtttaacgccagtagcgcattggcgccatcacgctcagaaacattggcggttgtcacatggactgccatcggcagcccattgatatctacagcaagatggcgcttaatcccactcacctttttaccaccatcgtagccgctactttcagcaggatcggtattcttgacactttgagcatctagaatgatgaacgatgtataaactgaacgcttctgagccaaccgatgttggctgacaatttttttaaaaccttatccagaggagtgataccagcaggagatggcgttttagtccaaagtaaccagtaataatagacggtttcccatttaggaaaatcgctgggtaaatcgcgccaaacgcacccatttttcaaggtataaagcagggcacaaaagatatcatataaatcaacctttcttggcttagtccgcttacgtatgccttctagatctgtccggattagttcaaattgttcacgagagatgtcgctactataatggtgtgcaaagcttttcatggattaaaaactcctgtttttgatctaatttaactaaaatcaaatcgaatgtcaaagtatccaaacacgttgttcacggctcataattaaatagtttcacaaaagttattgttgatttatgtaactgagcatgatatgatgttatagttgtgttaatcgtcatgccgacttagctcagctggcagagcatctgtcttgtaaacagggggtcggaggttcgaatcctctagtcggcattaactgaatagttatgcggaagtagttcagtggtagaacatcaccttgccatggtgggggtcgcgggttcgaatcccgtcttccgctttgttccagagtgttgccggggtggcggaattggcagacgcacaggacttaaaatcctgcggttagtgataaccgtaccggttcgatcccggtcctcggcacttttatgaagcacccatagcgcaattggatagagtgtctgactacgaatcagaaggttgtaggttcgactcctactgggtgcatataacgggaaatagctcagcttggtagagcacctggtttgggaccagggggtcgcaggttcgaatcctgttttcccgattaagtagtcatatacgattatttaacacatcgcggtgtagctcagctggctagagcgtccggttcatacccgggaggtcgagggttcgattccccctgccgcgataggaattagagcttggacctttagctcagttggttagagcagacggctcataaccgtccggtcgtaggttcgagccctacaaggtccatctactattaatagtggacatttcctagtaacatcatatggaggattacccaagtctggctgaagggaacggtcttgaaaaccgtcaggtgggtcaaaccacgcgagagttcgaatctctcatcctcctggtaaccggttgagtcgcatgtgaccaagctcagtatgagtgcgaccattaaaaatgtggttctgactaatgacgccagcgccaacaccggtaccaatcgtcatgtagatgctgttagggacgtccttagcgattccaatcattgattcgccataagcggcttcgttaacatcagtggtccagtagagtgggatgttgaagcgacttttaagatggcctaaaaagtcgaagtcaccccagccgggtttgggagtcgtggtaatgtaaccatatttcggatcatcgggattaacgccgatggggccaaatgaaccgataccaatcgcgtcaacgggatgagtcgtaaaatagtcgtctaccgcagtcatggtttcagcgggggttgtcgtggggatcgaaattcggtcgctaacttgcccgttttcagcgcccgtggcacaaacaaattttgtaccaccagcttcaattgcacctaaaagcatagtgtgcctcctgtagttaaaaatgtagtcttatttattaatggtatactcttaatcagaaactttattaacgattacattaactttgacgtaaatgttgcgcgctaggcctgattaaacctgtcagatcgttttatatcgctgtagcagcaactgagctagctgccggttcagtcaacgcaacgagcggttcaccagcttggacattcgtgactttgagtcgttcaacattagcgtaattggccgtatttgtgacgactagcatgacggttggatcatatttagcggcttttaaaactctgatttatgtggcccccttcaaattggaatttgtaatctaacataaacggcttattaatcacgcctaaccggctcttcaggttgtttttcagggtatattttttctggatttatttgggggttttcaggtggagtctttactggaaatatttgtggtaattgctttttaggcttttctattggtatatgaggagtaattttgtttgggtgtttttccaaaagtgatatcattagctatgcctccttaaattcttcttgaatggagtgtcgtcttttaaatcagagcgatgttgataccatttttccgcttgttccgtagcaattgaaatggcccgcttatcgtcataatttttttctttaagcgcatttgcgatctcaatagctttttttcgaaccacttttttcaaatttttcattgatggtgggtaattttgttcattccaaggcatttcaataacctccattcatatgattttagatatggaaaagagtatatagattatttgttatatattaaataagattacagcatgttggtaagcgctgtcaaaaaagttgctttagtttcaaccgatagtcactagactcatattttaactaagaaatagtatccatgtaatttgccccaaaaaggtttctaattatgaatttcgaactagacattgaattatgatgatattttacgctctcattaaaagtggttagggtcttgtgtggggattcacaaaagactggagttaaccggaacggtggtcacaaaaccaatttttgaacctaagaataaaacccgatttacggccagatttgacttacagattgggactcaaaaacaggttgtttgtttgattcacggccaattaacgcccttgaatctgggcagacggtaggcataacgggtcatcttggtagtcatcaaggcagtctggtagtggtgatttcgcagttggatgtgttagcgacggggctaaccttggaggtggactaatggcagttaatcagtcaggagacaagtttgttactctcgaaaagctaccagatcggtcttattttcaacgacgacgttactccaaattaaccagcgatcgcttaaaatactcgactggcaaacaccgtatcaggttattggattgaagtcaatatttgagacagattttaagagacattcagaaccgcgtttaccttccacagctcaaataaatcattaatcgtgattaataacttatttgaaccatggaaagcattaaatcaggcggccatttggctcgtaagtgttgcaatttcaacttgtaagggggtctggtagcccagtgaactatgaattctcttcctattgtagaaagcatgcacatattcaaaaaggacagcagcggcagtttcataattctcggatatactcctaccaaggtagacaagcaaataattaaagcttgtctattgaggaaggagtatttttatgggccaaaaaggttcgaggtacagtctggaagagaaactcttttatattggattggtaagagatggtgtatcagccacgtcaatccatagggagtacggtgttcatcactcacaagtggcacagtggatcatgcgatatgatgacggtgggccagaagcactgagtggtcgtcgatatcaacacgcgtactcagaagcgtttatgcttgaggtggtccaagcatacctagcaggcggcacttcatatccacaactagccagaaaatatggtattccaaatcattccattatctatcagtgggttaaccggtatactagtggtaaaccactcaaagccactaggaggccctccccaatgaaagacggtaggaaaaccaatcagattgaacgaatcgaaattgcacaatggaccattgccaatgaaatgaactacggtgccgcgaccactcacttcaatgtgtcttatggtcaagtgtatgcctggatcaagaaattcaagcaaggcggccccgacgcactcgcagatcgtcgaggtaaagctaaagaagataacggtaaattgactgaatcagaacttaaagatcgtacttgcaatttgccatgcgataatactaccgtcataaagatctttaacggcacttaagcgcaggcgttgcgccatctttgtgccatatcgtaactcactacaatcggtcacccaggtaatattcggccgttcaggggtaaagtcatgactaccatcttcacagagtaatttgttggcgagaatatattccttcttttctgccttgcggtcgcgtttggccactcgaattgacgagtagataccgtgattacgcatgatacgccgaactcggccttggcttacatggtaaggtgtctccgtgttgatgtacattgtcatagtacggacgccgtaaatgtagttttgggcttcttcacgcgcaataatgtagtttaatatcacgtcattctcaagctcatgagcggttactgcacggtgagtccacttgtagtatgcggcacgagagattccgacatagttacacataaagctgatgccatacggtcgcttagtgtcgggattcattttttgtgagagcgtttgaacggtttgatatttttcttctgaagtgcatctatcctttcgaactcttggagtttttttaatatcgcgacctccgtagagacacgttctagccgtgctttaaggcgtttgatttcaacattagttactccttttcttctcaacagaaccctgtgtttagtgtttcttttctggttttgaaaaggaacactaaatgcggggtataccaactgaaacgtagtgtaaggcggtagttaattctcaacattcgtattatttgttttaacgtcatttattcgttacactataattgtaagcgtattcaaaaaatagttgaaatgggagggatttatatgttggaaagagatttaacagttattggaagttacagtacgagagaagaagctttatccgtgatcgaacaactgcaaagagaaggctatagccgtgacgatatcattgtttacaccaacaaagatgcagctacaaattttggttttgctggactgtcaggaatcgatgttaaaaccggcgtaaatggcgtcgaaacgactcacgaagatcgctcactatgggaaaaaatcaaagatgcattttctgctgatacgtacgaatacgattcaagtttaaatgaagaagctgaccatgcaaacaacgacccgctttaccaatatagagatgatatctcagctggaaaaattattatcaccgtcaataattataaaaacgacccaacacaagcaactgaaaatgttacaggaagacggtgactgacatggcaatattccacatgagttttagtaatattagtgctggtaaaggacgaagtgcgattgccagtgccgcttatcgaagtggtgaaaagctatttgatgataaggaaggtcgccactatttttatgcccgatcgatcatgccagaaagctttattttgacgccaaaaaattcacctgaatgggcgagtgatcgagagcagttgtggaatgaagttgaaaagaaagatcgtaaatcaaactcacggtatgcaaaagagtttaacgtggctttgccagttgaactaagcgaagatgaacagaaagaattattgacaaaatacgtgcaagaaaattttgttgatcaaggcatggtagctgatgtagcgattcatcgcgacaacccagataatccgcacgctcatgtgatgttaactaatcggccgtttaattcagatggaacatggggaattaagagcaaaaagcaatatattttagatgataatggcaacaaaacatataccggaactagcaagtaccctaagagtagaaagatactgatggtcgattgggataaaaaagaaaaaataactgaatggcggcacaattgggcggcaagtgtaaatcactcaatgtttaaagcaactcgacaagcattcgcgggaatataaagtactgaaatcactatggcgcctattccacaaggccaaccctgacgcacaaaagagccgctacctcttcggcctgaatgagtactcgaccgaacagaacgctattgatattggaaccgatacgtttccggccttcaaaacagcttatgaaacctacatcgatctccacgatgctttgatggggcgtcacgctgatgaactcaagaatatcatcactaactatcagcctaacggcacgcccctagatacggccatgcataccctacgaaagaatcttaatggcgtaattaacgccgccaaatcgtcctactctaacggaccgatagagggcatcaaccgtaagatcaaggagctcaaacgtgcttgttatggcttctccaatcaggccaatatgttcacacgcgtctaccagctgattgcctagattatctaccacaataacgtcacgatggtaggcttatttgttatgccttcaagtacgatattcagacaacacaccagattaaacgccgcaactaataaaacaacaaaaaagatctcccaccagacatgcagctggtgccactcgcacaaataatttacatgcatcagatgctgcacgtgcaactgatctagatactgatactgatagtatccagcttaaaggagaagaattggatatcgataagcatgatgtgacgacgggtaaagtcgatgtccataaaaatgttgtcaatgagaagaaaacagtcgaagtaccggttaaacgagaagaagtcgtgatcgaaagaaagcccggagatggtgcggctgcaactaccgatgtcaatgatacgcaagaagacgacacgatcacgatcccaatcaaagaagaacagatcgatgtcaaaaaacgtccggtcgttcgagaagaagttgacattcgtaaacaagaacacgaagatatgaaacaagtaagtgaaaacgtcatccacgaagaactagatgtcgatacgagtggtgatgcccacgtagaagacttacgcgataatgatcgcaacaagcatgaccggaactagtttctagctttgattttatcaaaccttttgaacaagaacttaaaaaagattactggcagccatcagaaagaatatggctgtcagtaatcttttttaagttcttgttcaaaaggtttgataaaatcaaagccagaaactagctccggtcatgcttgttgcgatcattatcgcgtaagtcttctacgtgagcatcaccactcgtatcgatatctagttcttcgtggctgacgttttcacttacttgtttcatatcttcgtgttcttgtttacgaatgtcaacttcttctcgaacgaccgggcgtttgttgacatcgatctgttcttctttgattgggatcgtgatcgtgtcgtcttctagcgtatcattgacatcggtagttgcagccgcaccatctccgggctttctttcgatcacgatttcttctcgtttaaccggtacttcgactgttttcgtctcatcgacaacatttttatggatatcgactttacccgtcgtcacatcatgcttattgatatccaattgttcttctttaagctggatactatcagtatcagtatctagatcagttgcacgtgcagcatctgatgcatgtaaattatttgtgctagtgtcaccagctgcatgtcttaaaacaagccagctgggtggttaattgccgaccaaattccgtcctaccggacgatttgtcgctttagaatttctgatgaactggccactttgacaaccgatagcttatcacagctaacccaatatcttcgtcaaaatggcatgattgatgatgtttcatttattgatggaactaagatcctagccgacgccaacaagtatagctttgtttggaagaagaatacgatacgatttgacaagatgaatcgcgaaaaactcgttgacctgttaggcgagcttcatgaagctaaaattgtcggtgaaattccggcaggatcagagctgactcccgaactgttggatatcatgattagcaaggttgaggatcacttagtggtccttaatgaaaccgtggaagcaactaagcaggtttccccgaacccagccaaacagcaacgccggactgttaaatcacaaaaacgtaagttggacaaacgacgtgataaaatgcgtgaacaccaagcacagcaagcaatctatggtcagaggtagcttttttatggttgatataattattgtattgggtctcccggtgcatgaattttacctgtagaactaactccccaagcaagcccgtcatcgttgacaaagctccaagaaccattgtcgccttcacttgcgttcaagtcatctagtgatgtacctccaaaatcatcatccccattgccttgagatttagcccagtttcttagaatctgcttggcttgggattcagttaaggctgtagaaccagttgtagactgagtagaagaagactctgatgaactagagttttcgactgatgagctactttcagaagaatctatgtcatcattagtagagtttagtatcctttactatatataataaggaggcctctaatgctagtttttctgtcaacatcattcataccatccaatgataagatgtggtcacgagttggcataaataaaaatcaacaattcccgctcagaatacgttttcggtcgcccttcccgaaacaacggatcatgttgcttggcatacactttaccttcttgtgtgcgcgtgacaatcatatcgcgttcaaactgcgcaaaggcgctaaatattgtaaagactagttggccagtcggcgtattgtcaattaagcccatattcaaaatgttaactttgacattttctttaaacaactcttggataatggctaaggcctcgcgtgtgttccgcgcaaaccgatccaacttagtgacaatcaaagtatcgcctgtttttagaacgcgcaacagtttttgaaactccggtcgttcggtagttgtgccggtaaacttttcttgaaagattttttctgctcctgccaattttagtaactcaatttgatttgctaatttttgatcagtggtactgacccgcgcatagccatatttcatctttttatctccttagttaatagatctaaatggctacaatggctcggtagctcagtcggtagagcaatggattgaagctccatgtgtcggcggttcgattccgtcccgcgccatatctgtattctgcgggtatagtttagtggtaaaaccacagccttccaagctgttgtcgcgagtccgattctcgttacccgctttttttgggcctatagctcagctggtttagagcgcacgcctgataagcgtgaggtcgatggttcaagtccatttaggcccattttggagaagtactcaagtggctgaagaggtgcccctgctaagggtatagatcgcgcaagcggtgcgagggttcgaatccctccttctccgttgttccatattaaaaatatgaccccttggtcaagtggtttaagacactgccctttcacggcagtaacatgggttcgaatcccgtaggggtcattacattggcaatagatttaggatgacgttcccttaattttgaatggtgtccatggtcttagttaaatttttcttgtttctgcccaattgattcaattcagtaactatgacaacaccaccttaacaaatcataatttggataatagtatgttccatttgaaagctaagccttataattagcatagggttaatagctctaatcaaaatacccacaaaaggcctgctcaactaacaattgagtaggccctttgtagtacaaattaatccttatcacaactaacctcaatagcacaacaggtataaatagtgcctaaaatccctaaataaatttctctcacaactgtttaataaagcggcaatccccgttgtacatgattaattaaacattcaattcttaaaacacctatttttaaatcgacttaaaccttcgctgtgatctttacgttctgattcagtcaatttaccgttatcttctttagctttaccgcgacgatctgcgagtgcgtcggggccgccttgcttgaatttcttgacccaggcatacacttgaccataagatacattgaagtgagtggtcgcggcgccgtagttcatttcattggcaatggtccattgtgcaatttcgattcgttcaatctgattggttttcctaccgtctttcattggggaggtcctcctagtggctctgagtggtttaccactagtataccggttaacccactgatagataacagaatgatttggaatgccatattttctggctagttgtggatatgaagtgccgcctgctagatatgattggaccacttcaagcataaacgcttctgagtacgtgcggccatcttcttagatgccacttacttgccgttaaagcgggataccgttcaaaaagaagccgttcatattgcgattggcattcgtccagatggtacgaaagaagtgctgaactaccaagtggcgccaacggaatcgactggaatctggactgaactgctgggaaccttgatcaagcagggcgttaaagatgtgctgttgtttgtggccgatgggttagttggtttggatgaaggcttgaatcggcatttccctaaagccaaacgacaacgttgcctggttcatgttgggcggaatctgatgaacaaagttcgcgtaaaagaccgcaaggccgtgatcagtgactttaaacaagttcatcgggccgccaaccgtgaagcagccgatgagacgacccagcttgtggtcgatacgatgaagcaagctctaaaaacaactcatggtgtcaaacctgagattttacactctgatcagggatcggcctacacatcaggtgcatacaacacgttactagctggagaaggtatcgtgcacagtatgtctcgtcctggaaccccaggagacaacagtccgatggaaagcttctggagccaatttaagaccgaggagttggcattcaagcaaccactctccgaaatagagctcattaacatcatcaagaagtacatcaattggcataacacagcaagacgtcaattgacactaaacggcatgaccccggaagaataccggaatcatgccgttcaagaaagtgcataagattttaattgctggcttccctgtctgaggagaacgaaatcctaaaaaaagccctgggcttccttgcgcagaagtaaccaatatttttgattacattcaccaagaaagccataaccaccaggtaactaagatgtgccgaatcctcggtgtttccagagctcagtattatcgttatcgatccccaaagccttcaaaacgccgggccgaagatgcggacttaaaacaacggattctgcggatctttgcggaattcaagcagcgatacggcgttatgaagatccaccatgaattgaatctggaacttcaaccactgcagcgtcggtgcagcccaagacggatttcccggctcatgaaggaactggatatccactccgttaccgtcaataaaatatggcgttctgggtgttgaatggaaggaaagagccattcagaatccagctgatgatcaagtagccattgacggtacaataagagctctgtttgaacaggtttaaggtacaaggtattaggtttaccagtttttcggtcgtgaataaacgcattttgtttaatagaaccgtccggattaaaaatatcggcctgttttaagcgcatgacatcactgactcgcaacagtgtcgctttgccaacttgaaaaactgtatagttacgccggccagctttaaagttgttgagtaaggtatcttgaacctctttgagaacgtttgaatctttgatgggtaagacaacttgttgcatagtttgtgttagggaatagttcgtgcacgaatacctgataggaggcattcatgtccatgatgacgcgttgaaccgcggcccgttctgcggtgctgtactgactaagaaagaactgtttgatggttctattaaggtggtcgctaagtactttaactgatttgtgagtgtcggcgtcaatgcaaataaacgacatggagccgtgcgtggaacggaattcatcaaagcatagattaatcggtaaccgacggctcgcgtgtggatgaatattagccgtcaaaatacgctgacctgagtttgtcgaaataccggtgagactggcaatagtcttagccgggagtgatttactggctagcttcagctgatatcggcttttccaaaatccaaccgacacacgaaccttacaaccgtttattgaacatttaaaggccaacaatgtgttaggtcacaccatcgttgccgatgccggatacggttccgaaagtaattatcggtacttggaagatgaattcggtcagcataccgttttaattccatacggcacaatgcttaaagagaatagtcgaaaatggcaaagtgatgaccgtaaggttatgaactgggactatcatgaaaaagatgattattttatcaatccgcaaaacgtccggtttaattttaatgcttatcgtcaacggactgataagtatggttttacccgtgacttgaccccaataatcatcatctgattcaacaatttcatcgtcaggtaaaacatggcgtttaattaactgatcacgtgcaattgcatattctaacgaaccttctttagcttttaatgctctttctagccagtccattttttcttgtgaaacgatggctactgcgcgactatttgaacgagcaatataaacggtttcgtcttcgtcattaacttgatctaaatatttttttaggttagcgcgaaaatcgctctgtgttagtgctaatgtcatatttaccaccctttcattgtacttaatattgtactttaatttgtactaaaaatcaattttttaaggagctgctggcaaggtatgattttcaaaccggccattgcgatctcgaggaatggttaagttaagttggccgtacttcgtatcaaacgagcgctcataactgccgttgcggttattaccagtgttaatcccagcgtatgagtagcgttcgtaacccaaaaactctgccaattcggtttgaagcagctggttaatcgcaatttcgaggtggtgacgaaaaacttcgtccaaatcttgcttttgggctagtgcagcgataatttctgtggtaagttcattcatggggaatgcctcctgtgatgttttctgtgttaaagaatacattgccgaaaagtatgatgaaaatcatcaactaatttccgcggcactaacaccaaaaggatatcttaaaaggatttccgtgaacgaaaattgggaatatttcaaatcgaaacaacgagaattactttcagctccagaaactggtcagatttacgctcaacgtaagatcgatgttgagccagtttttggcaagatgaaggcttctttacatttcaatcgattctcggtgcgaggtttcgacaaggtcaccaaggaagccggaatcgtaatactggcgttaaacattatgaaacaataaaaaaagagcatcggtcgcacccgatactctacgaaattatcctcgaaaggacattcctaatatgcaagattattataacatgaatcaaaccactttgagtatcgccttggattaccaaccagaagagcatcattctgctcgttacatcaaccagcttgttgagagtttaaaactaaaatatgattaccagtttggccgtccgcgggaatataacctcggtgccatgttaaaactggtccttttagcgtacagctatggcattttcagcagtcgtaaaattgaacagtttgcccgtggtgtggataatcaggtccccagtaatggttcgatttttaaccgcgctttccagggtctttaagactaaatcagtatccatctttttttgagaatgaatagccgataattcgtcttgagtgcagatccatgatggttgataagtaacaccagccattacgcttcgtttgaatataggtcatatcagcggtccatttttgatttaaactagtggtcgagaaatcctgcttaagcaagttgggacgctgttcaaccttggttttggaagccgaagccgctttccattggatgtaagctgattcctgagacaacttttaagagagcgtataatgaataaatcgtctctcaaaaggaagaaatttttacatgccaactcgttacgacaaagaattcaaacaaaacatcatcaacctatataaacaaggcgaatcagccgcccaactggctagagaatatggcattggctattcaaccgttcataattggatccagggccaagccaaaactcaatccggtaaatcgccagacgaaattaaagcgatggaaaagcaggaacttagttagggcttcattaacagtcgctgtcgtccgatcttttaaccggtatgcccaaaggaaccgtgatttgcgatcgattaaagttaataaaactgccttactatgcccacgaggaccaacgactgtatctagttcaaaatcgccgatgcgattacgttgattaatcatcatgggacgctgttcaattgatcgccccaaagattgattatatttggatcgttggtcaacgttacgccgttggcgtacgccatgttcaggtcaatgacgactaacgtcgtcaatggagaatagcgggatcgaaccgctgaccccctgcttgcaaagcaggtgctctcccagctgagctaattccccatgaggtattcaacttatggaaccaactggttcggttccaatgggcctaaatggacttgaaccatcgacctcacgcttatcaggcgtgcgctctaaaccagctgagctataggcccaaaaaacgcttattaaattgagagttagacctctcaaaactaaacaaagtttcgatgcgttgatatcggcgacccagtgcttctggcccaccgtcatcatatcgcatgatccactgtgccacttgtgaatcatgaataccgtactttcggcggattgacttagctgatacgccatccttcaccaatctaatatagaaaagtttctcttccaggctgtaccttgaaccttttcggcccataaaaaatactccttcctcaatagacaagctttaattatttgcttgtctaccttggtaggagtatacccaattaaactgagaaaccaggaagcaatccagtgaatcttcagttggaaattgttctttgtggtgggtggtgcgcttgagatgcttattaaagttctcaatcaggttagtggagtatagtgattgccggatagctggtggaaagtccatgaaagtgagtaaattcggcattttaagcagatctttgattaatttgggataggtctgatgccagttgttggcgaattcattcagtttcagcactgaaactgaatgagttcgccaacaactggcatcagacctatcccaaattaatcaaagatctgcttaaaatgccgaatttactcacttgcatggactttccaccagctatccggcaatcactatactccactaacctgattgagaactttaataagcatctcaagcgcaccacccaccacaaagaacaatttccaacggaagattcactggattgcttcctggtttctcagtttaatggaattcccatgaggcatactaaatacaatattggagactacgttttaaattgcaaataattcggattaaatttgtaatctaccttaatctatttcgtttagtatcctttactatatataataaggaggtctctaatgctagtttttctgtcaacatcattcataccatccaatgataagatgtggtcacgagttggcataaataaaaatcaacaattcccgtaatgagccgtgacagtctcgaactgtcgaccctctgattaaaagtcagatgctctaccaactgagctaacggctcatgatggaggatacagggctcgaacctgtgaccctctgcttgtaaggcagacgctctcccaactgagctaatcctccaatttcgcatggcaacgtcctaccctcgcagggagcgatcccccaactactctcggcgctaagaagctatgtggataatcaagtccccagtaatggttcgatttttaaccgcgctttccagggtctttaagactaaatcagtagccatcttttttgagaacgaatagccgataatccgtcgtgagtgcaggtccatgatggttgataagtaacaccagccattacgcttcgtttgaatataggtcatatcagcggtccatttttgatttaaaccagtggtcgggtatttcgacaaactcagttcagcgtattttgacggctaatattcatccacacgcgagccgccggttaccgattaatctatgctttgatgaattccgttccacgcacggctccatgtcgtttatttgcattgacgccgacactcacaaatcagttaaagtacttagcgaccgccttaatagaaccatcaaacagttctttcttagtcaagttagattgtaaaattaatctgaatgctgttcgtacaaaataaattaggttcacttcacaatgattttttgattgtttactaacaaattttataattaatagaactagccaggccacaacttaacagttgtggcctgttttttgatactttataattaaagggttagaaccgtgtcactacttaatgacataagttattgtgaagccagtcgacgttgctggaaagcttgaacctgttcattgacggctttagtcatgttggaaaccgtggctttggagtagtgagcaccgtacattttctcaatgagttcggcaatttcagcagtggtaattcccttggtatacaactgaatgaccgttgtttctaaattatcactgtgccgaccgtagctgtggatacaatacgttgcaccctaacggacacaagctcactcatgtccacattgcaggacccatggaccggcccgtaattctagagctaaacaagcaacgctggcgttgtagtaactgccatagcacttgtacggccaccactccagtggtatcaaccaaccacgccatcggtcacggactagcgactcatgacggagaaatttataactaccaaggtattagagaagaattgatcaacaagggtcatacttttactaccgaaacagatacagaagtattgttacatggttttgaagagtggggaatggaagaattacttaagaaaattcggaagtttgtcaaatggtgttgaaggatagtttctatccttgggagatctcctcgcacggaaaaacagttctacaaaatcatgagcaaggttggcgatctgttaggaattaattatctagggacccatacgatgcgtaaaaccggggcttatcgcgtttacacgcaatcaaattataatattggcttagtcatgaatttgctaaatcattccagtgaagcaatgacaaagaccggcactggataaacacattcctttttgagggaagcatgaaaagattccattggtgcattatcgtatggacaccccttacggctgtaagagtggcggatatgtagttctgttaaccgttggttgtaatcatcgctggtgtactgtgatcctaagtcttattatcgcgggatggagcagtctggtagctcgtcgggctcataacccgaaggtcgcaggttcaaaccctgctcccgcaattggtccgttggtctagttggtttaggacgcctgcctgtcacgcaggagatcacgagttcgagtctcgtacggaccgttacgtacagcaccgcagaacgggccgcggttcaacgcgtcatcatggacatgaacgcctcctatcaggcattcgtgcacgaactattccctaacaccgaactcattattgatcggttccacattattcaattaatgggccggacgatggataccattcgccttttgctttaactcatcgctcagcttagttttccgaccacatcgtgatcgcttgtattcggcatctgtttgtgctaattcagcctgataaggttgacatcgagataattcataagaaattgttgacggtgatcggttcagccgaacgcccatttgagtaaaaccagacgtggaaaccacgtggtcttttagttgattcagtaaaagaagccgaagccaaagtgaagacgttggtttcggcttctttggcttttaattgcgggaacgcacacaaagagccaaaaaagattactgacagccatctaaccacttttaatggtccggtgcacagctttactgtggaccgtggcactgagtttagtgggctagtatcacttgaatcacaatatggtattaagacctattactgccatgcttatacgccagctgaacgtggtagtaatgaacgcctgcgacagcgcctgagtgtgtaggtaagctctgcctggatgaccaaatactttttgcgacccgagccccgaccatgaaattcctcacgagtaccgaacacctgaatgtttgtgtctgtaattcccagtaatttaagtgtattgagcttcttagcgccgagagtagttgggggatcgctccctgcgagggtaggacgttgccatgcgattattccgacatagctcagttggtagagcgcttgactgttaatcaagatgtcgacggttcgagcccgcctgtcggagtggtagcgtcaagaatcttgtgtaaatgaaatgccttcgtacatataatatgtatctaacttaaataaatgatgcttccaaggtgtcctggagtcctttgaaccctcggtggatccgcttcagagacttctcgttataaactcgccatctccattactgagtttcaaagtgatgtaataagctccagaacacttgttatatcaatattcattaaagctatcctaacgggatagctttttttgtcctattttgattagcgtgctacttcacgtaacagctactctaagacggatcacgatgccacctttatgcgggtcaaggaagatccgatgcaaaacggtcaattaaaacctgcctacaacgttcaaatcgccacgagtaatcagttcattacggagatcattcaaggagaaaccaattctcccctgatttagccaattataaatagatttagtagctagtttaaattcgtgagcaatcattcctggtgaccagcttagacgtaaatggttgagaattgatttaacgacgacgttactccaaattaaccagcgaccgcttaaaatactcgactggcaaacaccgtatcaggttatgctgacaaatttgtccaaaaattcggattaaatttgcaatctaccgaggctgtgacataactagcctctgtataagcaaatgggacgagaaaccgaattttggtttctcgtcccatttgcttacgcctttgatttttaaagttggtccctaccgtgaccaggtttcgattttaattcgttcggaataggttatactagacaaaagatcagctcctaaaagatgggtttgtggtaaacaccattttaaaggaagctgatcttttttgtccgtaacttctgtgttcgacatgggaacaggtgtatccttctcgccatcatcgccacactatgtgaaactaaatattcaattgattaatattcatttaaccttgcggttagacgaattgtcaaatcaagcgcaactttttgccgaagaaaacttcacttggacttttccatcccaagaccttgcgtggacggttatttaaatctgtgacgtgtcacagatttaaataaccgtccacgcaaggtcttgggatggaaaagtccaagtgaagttttcttcggcaaaaagttgcgcttgatttgacaattcgtc

SEQ ID NO: 15 - DNA, 1477 bp, Bifidobacterium adolescentis
  source 1..1477: mol_type = genomic DNA
nnnnttgtggagggttcgattctggctcaggatnaacgctngcggcgtgcttaacacatgcaagtcgaacgggatcggctngagcttgctccggctgtgagagtggcgaacgggtgagtaatgcgtgaccgacctgccccatacaccggaatagctcctggaaacgggtggtaatgccggatgctccagttggatgcatgtccttctgggaaagattctatcggtatgggatggggtcgcgtcctatcagcttgatggcggggtaacggcccnccatggcttcgacgggnagccggcctgagagggcgaccggccacattgggactgagatacggcccngactcctacgggaggcagcagtgggnaatattgcacaatgggcgcaagcctaatgcagcgacgccgcgtgcgggatgacggccttcgggttgtaaaccgcttttgactgggagcaagccttcggggtgagtgtacctttcgaataagcaccggctaactacgtgccagcagccncggtaatacgtagggtgcnagcgttatccggaattattgggcgtaaagggctcgtaggcggttcgtcgcgtccggtgtgaaagtccatcgcttaacggtggntccgcgccgggtacgggcggncttgagtgcggtagggnagactggaattccnggtgtaacggtggaatgtgtagatatcgggaagaacaccaatggcgaaggcaggtctctgggcngtnactgacgctgaggagcgaaagcgtggggagcgaacaggattagataccctggtagtccacgccgtaaacggtggatgctggatgtggggaccattccacggtctccgtgtcggagccaacgcgttaagcatcccgcctggggagtacggccgcaaggctaaaactcaaagaaattgacgggnnccnncacaagcggcngagcatgcggattaattcgatnnaacgcgaagaaccttacctgggcttgacatgttcccgacaggccccagagatgggnnntccttcgggncgggntcacaggtggngcatggtcgtcgtcagctcgtgtcgtgagatgttgggttaagtcccgcaacgagcgcaaccctcgccctgtgttgccagcacgtcgtggtggnaactcacgggngaccgccggggtcaactcggaggaaggtgggnatgacgtcagatcatcatgccccttacgtccagggcttcacgcatgctacaatggccggtacaacgggatgcgacctcgtgagggggagcggatcccttaaaaccggnctcagttcggattggagtctgcaacccgactccatgaaggcggagtcgctagtaatcgcggatcagcaacgccgcggtnaatgcgttcccgggccttgtacacaccgcccgtcaagccatgaaagtgggtagcacccgaagccggtggcccnacctttttggggggagccgtctaaggtgagnctcgtgatngg

SEQ ID NO: 16 - DNA, 1532 bp, Bifidobacterium bifidum
  source 1..1532: mol_type = genomic DNA
tttttgtggagggttcgattctggctcaggatgaacgctggcggcgtgcttaacacatgcaagtcgaacgggatccatcaagcttgcttggtggtgagagtggcgaacgggtgagtaatgcgtgaccgacctgccccatgctccggaatagctcctggaaacgggtggtaatgccgnatgttccacatgatcgcatgtgattgtgggaaagattctatcggcgtgggatggggtcgngtcctatcagcttgttggtgaggtaacggctcaccaaggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgtttgggagcaagccttcgggtgagtgtacctttcgaataagcgccggctaactacgtgccagcagccgcggtaatacgtagggnnnnagcgttatccggatttattgggcgtaaagggctcgtaggcggctcgtcgcgtccggtgtgaaagtccatcgcttaacggtggatctgcgccgggtacgggcgggctggagtgcggtaggggagactggaattcccggtgtaacggtggaatgtgtagatatcgggaagaacaccgatggcgaaggcaggtctctgggcngtcactgacgctgaggagcnaaagcgtggggagcgaacaggattagataccctggtagtccacgccgtaaacggtggacgctggatgtggggcacgttccacgtgttccgtgtcggagctaacgcgttaagcgtcccgcctggggagtacggccgcaaggctaaaactcaaagaaattgacgggggccngcacaagcggcggagcatgcggattaattcgaacnaacgcgaagaaccttacctgggcttgacatgttcccgacgacgccagagatggcgtttcccttcggggcgggttcacaggtggtgcatggtcgtcgtcagctcgtgtcgtgagatgttgggttaagtcccgcaacgagcgcaaccctcgccccgtgttgccagcacgttatggtgggaactcacgggnnaccgccggggttaacncggaggaaggtggggatgacgtcagatcatcatgccccttacgtccagggcttcacgcatgctacaatggccggtacagcgggatgcgacatggcgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggcagcacccgaagccggtggcctaaccccttgtgggatggagccgtctaaggtgaggctcgtgnttgggactaagnngtaacaagnnnnnngtaccggaagnnnnnnnnngatcacctcctttct

SEQ ID NO: 17 - DNA, 1477 bp, Bifidobacterium longum
  source 1..1477: mol_type = genomic DNA
gatgaacgctggcggcgtgcttaacacatgcaagtcgaacgggatccatcaagcttgcttggtggtgagagtggcgaacgggtgagtaatgcgtgaccgacctgccccatacaccggaatagctcctggaaacgggtggtaatgccggatgttccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccatactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgcaggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgtagagatacggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacactgcccgtcaagtcatgaaagtgggcagcacccgaagccggtggcctaaccccttgtgggatggagccgtctaaggtgaggctcgtgattgggactaagtcgtaacaaggtagccgtaccggaagg

SEQ ID NO: 18 - DNA, 1569 bp, Lactobacillus acidophilus
  source 1..1569: mol_type = genomic DNA
nnaaaacgagagtttgatcctggctcaggacgaacgctggcggcgtgcctaatacatgcaagtcgagcgagctgaaccaacagattcacttcggtgatgacgttgggnaacgctagcggcggatgggtgagtaacacgtggggaacctgccccatagtctgggataccacttggaaacaggtgctaataccggataagaaagcagatcgcatgatcagcttataaaaggcggcgtaagctgtcgctatggnntggccccgcggtgcattagctagttggtagggtaacggcctaccaaggcaatgatgcatagccgagttgagagactgatcggccacattgggactgagacacggcccaaactcctacgggaggcagcngtagggaatcttccacaatggacgaaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcnagcgttgtccggatttattgggcgtaaagcgagcgcaggcggaagaataagtctgatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcnnaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacggggncccgcacaagcggtggagcatgtggtttaattcgaagcaacgcgaagaaccttaccaggtcttgacatctagtgcaatccgtagagatacggngttcccttcggggacactaagacaggtggtgcatggctgtcgtcagctcgtgtcgtgagatgttgggttaagtcccgcaacgagtgcaacccttgtcattagttgccagcattaagttgggcactctaatgagactgccggtgacaaaccggaggaaggtggggatgacgtcaagtcatcatgccccttatgacctgggctacacacgtgctacaatggacagtacaacgaggagcaagcctgcgaaggcaagcgaatctcttaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccttcgggaaggagccgtctaaggcagggcagatgacnnnnnnnnnnnngtaacaagnnnnnnnnnnnngaacctgnnnnnngatcacctcctttcta

SEQ ID NO: 19 - DNA, 1512 bp, Lactobacillus delbrueckii
  source 1..1512: mol_type = genomic DNA
ntcaaattgagagtttgatcctggctcaggacgaacgctggcggcgtgcctaatacatgcaagtcgagcgagctgaattcaaagatcccttcggggtgatttgttggatgctagcggcggatgggtgagtaacacgtgggcaatctgccctaaagactgggataccacttggaaacaggtgctaataccggataacaacatgaatcgcatgattcaagtttgaaaggcggcgyaagctgtcactttaggatgagcccgcggcgcattagctagttggtggggtaaaggcctaccaaggcaatgatgcgtagccgagttgagagactgatcggccacattgggactgagacacggccnnaactcctacgggaggcagcagtagggaatcttccacaatggacgcaagtctgatggagcaacgccgcgtgagtgaagaaggtcttcggatcgtaaagctctgttgttggtgaagaaggatagaggcagtaactggtctttatttgacggtaatcaaccagaaagtcacggctaactacgtgccagcagccgcggtaatacgtaggtggcaagcgttgtccggatttattgggcgtaaagcgagcgcaggcggaatgataagtctgatgtgaaagccnacggctyaaccgtggaactgcatcggaaactgtcattcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagcgctaggtgttggggactttccagtcctcagtgccgcagcaaacgcattaagcnntccgcctggggagtacgaccgcaaggttgaaactcaaaggaattgacgggggccngcacaagcggtggagcatgtggtttaattcgaagnaacgcgaagaaccttaccaggtcttgacatcctgcgctacacctagagataggtngttcccttcggggacgcagagacaggtggtgcatggctgtcgtcagctcgtgtcgtgagatgttgggttaagtcccgcaacgagcgcaacccttgtctttagttgccatcattaagttgggcactctaaagagactgccggtgacaaaccggaggaaggtggggatgacgtcaagtcatcatgccccttatgacctgggctacacacgtgctacaatgggcagtacaacgagaagcgaacccgcgagggtaagcggatctcttaaagctgytctcagttcggactgcaggctgcaactcgcctgcacgaagctggaatcgctagtaatcgcggatcagcacgccgcggtgaatacgttcccgggccttgtacacaccgcccgtcacaccatggaagtctgcaatgcccaaagtcggtgagataacctttataggagtcagccgcctaaggcagggcagatgacnggg

SEQ ID NO: 20 - DNA, 1487 bp, Lactobacillus helveticus
  source 1..1487: mol_type = genomic DNA
acgaacgctggcggcgtgcctaatacatgcaagtcgagcgagcagaaccagcagatttacttcggtaatgacgctggggacgcgagcggcggatgggtgagtaacacgtggggaacctgccccatagtctgggataccacttggaaacaggtgctaataccggataagaaagcagatcgcatgatcagcttataaaaggcggcgtaagctgtcgctatgggatggccccgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaattccatgtgtagcggtggaatgcgtagatatatggaagaacaccagtggcgaaggcgactctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccatcctaagagattaggagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgataaaccggaggaaggtggggatgacgtcaagtcatcatgccccttatgacctgggctacacacgtgctacaatggacagtacaacgagaagcgagcctgcgaaggcaagcgaatctctgaaagctgttctcagttcggactgcagtctgcaactcgactgcacgaagctggaatcgctagtaatcgcggatcagaacgccgcggtgaatacgttcccgggccttgtacacaccgcccgtcacaccatggaagtctgcaatgcccaaagccggtggcctaaccttcgggaaggagccgtctaaggcagggcagatgactggggtgaa

SEQ ID NO: 21 - DNA, 1571 bp, Lactobacillus reuteri
  source 1..1571: mol_type = genomic DNA
agagtttgatnntggctcaggatgaacgccggcggtgtgcctaatacatgcaagtcgtacgcactggcccaactgattgatggtgcttgcacctgattgacgatggatcaccagtgagtggcggacgggtgagtaacacgtaggtaacctgccccggagcgggggataacatttggaaacagatgctaataccgcataacaacaaaagccgcatggcttttgtttgaaagatggctttggctatcactctgggatggacctgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacgccgcgtgagtgaagaagggtttcggctcgtaaagctctgttgttggagaagaacgtgcgtgagagtaactgttcncgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttnccttcggggacgcaatgacaggtggtgcatggtcgtcgtcagctcgtgtcgtgagatgttgggttaagtcctgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaagctcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtaggagagcctgcggctggatcacctcctttnt

SEQ ID NO: 22 - DNA, 1552 bp, Lactococcus lactis
  source 1..1552: mol_type = genomic DNA
nnttatttgagagtttgatcctggctcaggacgaacgctggcggcgtgcctaatacatgcaagttgagcgctgaaggttggtacttgtaccgactggatgagcagcgaacgggtgagtaacgcgtggggaatctgcctttgagcgggggacaacatttggaaacgaatgctaataccgcataaaaactttaaacacaagttttaagtttgaaagatgcaattgcatcactcaaagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttggtagagaagaacgttggtgagagtggaaagctcatcaagtgacggtaactacccagaaagggacggctaactacgtgccagcagccgcggtaatacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcnnaagcgtggggagcaaacaggattagataccctggtagtccacgccgtaaacgatgagtgctagatgtagggagctataagttctctgtatcgcagctaacgcaataagcactccgcctggggagtacgaccgcaaggttgaaactcaaaggaattgacgggggccngcacaagcggtggagcatgtggtttaattcgaagcaacgcgaagaaccttaccaggtcttgacatactcgtgctattcctagagataggaagttccttcgggacacgggatacaggtggtgcatggttgtcgtcagctcgtgtcgtgagatgttgggttaagtcccgcaacgagcgcaacccctattgttagttgccatcattaagttgggcactctaacgagactgccggtgataaaccggaggaaggtggggatgacgtcaaatcatcatgccccttatgacctgggctacacacgtgctacaatggatggtacaacgagtcgcgagacagtgatgtttagctaatctcttaaaaccattctcagttcggattgtaggctgcaactcgcctacatgaagtcggaatcgctagtaatcgcggatcagcacgccgcggtgaatacgttcccgggccttgtacacaccgcccgtcacaccacgggagttgggagtacccgaagtaggttgcctaaccgcaaggagggcgcttcctaaggtaagaccgatgacnngggnnnnnngtaacaagnnnnnnngtatcggaagnnnnnnnnngatcacctcctttcta
